(12) United States Patent
Joung et al.

(10) Patent No.: US 10,119,133 B2
(45) Date of Patent: *Nov. 6, 2018

(54) USING TRUNCATED GUIDE RNAS (TRU-GRNAS) TO INCREASE SPECIFICITY FOR RNA-GUIDED GENOME EDITING

(71) Applicant: The General Hospital Corporation, Boston, MA (US)

(72) Inventors: J. Keith Joung, Winchester, MA (US); Jeffry D. Sander, Ames, IA (US); Yan-fang Fu, Malden, MA (US); Morgan Maeder, Brookline, MA (US)

(73) Assignee: The General Hospital Corporation, Boston, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 14/775,930

(22) PCT Filed: Mar. 14, 2014

(86) PCT No.: PCT/US2014/029068
§ 371 (c)(1),
(2) Date: Sep. 14, 2015

(87) PCT Pub. No.: WO2014/144592
PCT Pub. Date: Sep. 18, 2014

(65) Prior Publication Data
US 2016/0024523 A1    Jan. 28, 2016

Related U.S. Application Data

(60) Provisional application No. 61/799,647, filed on Mar. 15, 2013, provisional application No. 61/838,178, filed on Jun. 21, 2013, provisional application No. 61/838,148, filed on Jun. 21, 2013, provisional application No. 61/921,007, filed on Dec. 26, 2013.

(51) Int. Cl.
| | | |
|---|---|---|
| C07H 21/02 | (2006.01) | |
| C12N 15/00 | (2006.01) | |
| A61K 48/00 | (2006.01) | |
| C12N 15/10 | (2006.01) | |
| C12N 9/22 | (2006.01) | |
| C12N 15/63 | (2006.01) | |
| C12N 15/85 | (2006.01) | |
| C07K 14/005 | (2006.01) | |
| C07K 14/195 | (2006.01) | |
| C12N 9/02 | (2006.01) | |
| C12N 9/10 | (2006.01) | |
| C12N 9/16 | (2006.01) | |
| C12N 9/96 | (2006.01) | |
| C12N 15/01 | (2006.01) | |

(52) U.S. Cl.
CPC .......... *C12N 15/102* (2013.01); *C07K 14/005* (2013.01); *C07K 14/195* (2013.01); *C12N 9/0071* (2013.01); *C12N 9/1007* (2013.01); *C12N 9/16* (2013.01); *C12N 9/22* (2013.01); *C12N 9/96* (2013.01); *C12N 15/01* (2013.01); *C12N 15/63* (2013.01); *C12N 15/85* (2013.01); *C12Y 301/21004* (2013.01); *C07K 2319/00* (2013.01); *C07K 2319/01* (2013.01); *C12N 2710/00033* (2013.01); *C12N 2770/00033* (2013.01); *C12N 2800/80* (2013.01); *C12Y 114/11* (2013.01); *C12Y 201/01* (2013.01); *C12Y 301/00* (2013.01)

(58) Field of Classification Search
None
See application file for complete search history.

(56) References Cited

U.S. PATENT DOCUMENTS

| | | | |
|---|---|---|---|
| 4,603,044 A | 7/1986 | Geho et al. | |
| 4,957,773 A | 9/1990 | Spencer et al. | |
| 5,436,150 A | 7/1995 | Srinivasan | |
| 6,007,988 A | 12/1999 | Choo et al. | |
| 6,013,453 A | 1/2000 | Choo et al. | |
| 6,503,717 B2 | 1/2003 | Case et al. | |
| 6,511,808 B2 | 1/2003 | Wolffe et al. | |
| 7,021,555 B2 | 4/2006 | Bagnall | |
| 7,220,719 B2 | 5/2007 | Case | |
| 7,914,796 B2 | 3/2011 | Miller | |
| 7,919,277 B2 | 4/2011 | Russell et al. | |
| 8,034,598 B2 | 10/2011 | Miller | |
| 8,071,370 B2 | 12/2011 | Wolffe | |

(Continued)

FOREIGN PATENT DOCUMENTS

| | | |
|---|---|---|
| CN | 103224947 | 7/2013 |
| CN | 103233028 | 8/2013 |

(Continued)

OTHER PUBLICATIONS

Haft, et al. A Guild of 45 CRISPR-Associated (Cas) Protein Families and multiple CRISPER/cas Subtypes Exist in Prokaryotic Genomes. PLOS, 2005.1 (6) 0474-0443.*

(Continued)

*Primary Examiner* — Christopher M Babic

(74) *Attorney, Agent, or Firm* — Fish & Richardson P.C.

(57) ABSTRACT

CRISPR-Cas genome editing uses a guide RNA, which includes both a complementarity region, which binds the target DNA by base-pairing, and a Cas9-binding region, to direct a Cas9 nuclease to a target DNA. Further disclosed are methods for increasing specificity of RNA-guided genome editing using CRISPR/Cas9 systems by using truncated guide RNAs (tru-gRNAs).

11 Claims, 28 Drawing Sheets
Specification includes a Sequence Listing.

(56) References Cited

U.S. PATENT DOCUMENTS

| | | |
|---|---|---|
| 8,252,535 B2 | 8/2012 | Biekle et al. |
| 8,282,920 B2 | 10/2012 | Heo et al. |
| 8,361,725 B2 | 1/2013 | Russell et al. |
| 8,697,359 B1 | 4/2014 | Zhang |
| 8,771,986 B2 | 7/2014 | Miller |
| 8,865,406 B2 | 10/2014 | Zhang et al. |
| 8,962,281 B2 | 2/2015 | Doyon |
| 8,993,233 B2 | 3/2015 | Zhang et al. |
| 9,023,649 B2 | 5/2015 | Mali et al. |
| 9,074,199 B1 | 7/2015 | Chavez et al. |
| 9,322,037 B2 | 4/2016 | Liu et al. |
| 9,885,033 B2 | 2/2018 | Joung et al. |
| 2002/0160940 A1 | 10/2002 | Case et al. |
| 2002/0164575 A1 | 11/2002 | Case et al. |
| 2006/0199190 A1 | 9/2006 | Russell et al. |
| 2007/0020627 A1 | 1/2007 | Barbas, III |
| 2008/0124725 A1 | 5/2008 | Barrangou et al. |
| 2008/0193470 A1 | 8/2008 | Masignani et al. |
| 2010/0034924 A1 | 2/2010 | Fremaux et al. |
| 2010/0055793 A1 | 3/2010 | Chandrasegaran |
| 2010/0076057 A1 | 3/2010 | Sontheimer et al. |
| 2010/0093617 A1 | 4/2010 | Barrangou et al. |
| 2010/0104690 A1 | 4/2010 | Barrangou et al. |
| 2010/0120043 A1 | 5/2010 | Sood et al. |
| 2010/0183559 A1 | 7/2010 | Van Sinderen et al. |
| 2010/0184624 A1 | 7/2010 | Samuel et al. |
| 2010/0209998 A1 | 8/2010 | Attwood et al. |
| 2010/0209999 A1 | 8/2010 | Altermann et al. |
| 2010/0221185 A1 | 9/2010 | Altermann et al. |
| 2010/0311061 A1 | 12/2010 | Korlach et al. |
| 2010/0317116 A1 | 12/2010 | Flusberg et al. |
| 2011/0002889 A1 | 1/2011 | Barrangou et al. |
| 2011/0092381 A1 | 4/2011 | Sood et al. |
| 2011/0143348 A1 | 6/2011 | Tomigahara et al. |
| 2011/0150852 A1 | 6/2011 | Chambaud et al. |
| 2011/0171647 A1 | 7/2011 | Tomigahara et al. |
| 2011/0189674 A1 | 8/2011 | Tomigahara et al. |
| 2011/0189776 A1 | 8/2011 | Terns et al. |
| 2011/0201007 A1 | 8/2011 | Waller et al. |
| 2011/0201118 A1 | 8/2011 | Yang et al. |
| 2011/0217739 A1 | 9/2011 | Terns et al. |
| 2011/0217791 A1 | 9/2011 | Tomigahara et al. |
| 2011/0223638 A1 | 9/2011 | Wiedenheft et al. |
| 2011/0236530 A1 | 9/2011 | Manoury et al. |
| 2011/0236894 A1 | 9/2011 | Rao et al. |
| 2011/0269119 A1 | 11/2011 | Hutchison et al. |
| 2011/0300528 A1 | 12/2011 | Jassim et al. |
| 2011/0300538 A1 | 12/2011 | Barrangou et al. |
| 2012/0027786 A1 | 2/2012 | Gupta et al. |
| 2012/0088676 A1 | 4/2012 | Weill et al. |
| 2012/0151635 A1 | 6/2012 | Coruzzi et al. |
| 2012/0214160 A1 | 8/2012 | Deng et al. |
| 2013/0011516 A1 | 1/2013 | Griffin et al. |
| 2013/0011828 A1 | 1/2013 | Barrangou et al. |
| 2013/0130248 A1 | 5/2013 | Haurwitz et al. |
| 2013/0145497 A1 | 6/2013 | Choi et al. |
| 2013/0150240 A1 | 6/2013 | Newman et al. |
| 2013/0158245 A1 | 6/2013 | Russell et al. |
| 2013/0253040 A1 | 9/2013 | Miller et al. |
| 2013/0288251 A1 | 10/2013 | Horvath et al. |
| 2013/0326645 A1 | 12/2013 | Cost et al. |
| 2013/0326725 A1 | 12/2013 | Shukla et al. |
| 2013/0330778 A1 | 12/2013 | Zeiner et al. |
| 2013/0337454 A1 | 12/2013 | Duchateau |
| 2014/0068797 A1 | 3/2014 | Doudna et al. |
| 2014/0093941 A1 | 4/2014 | Terns et al. |
| 2014/0113376 A1 | 4/2014 | Sorek et al. |
| 2014/0170753 A1 | 6/2014 | Zhang |
| 2014/0179006 A1 | 6/2014 | Zhang |
| 2014/0179770 A1 | 6/2014 | Zhang et al. |
| 2014/0186843 A1 | 7/2014 | Zhang et al. |
| 2014/0186919 A1 | 7/2014 | Zhang et al. |
| 2014/0186958 A1 | 7/2014 | Zhang et al. |
| 2014/0189896 A1 | 7/2014 | Zhang et al. |
| 2014/0199767 A1 | 7/2014 | Barrangou et al. |
| 2014/0201857 A1 | 7/2014 | Fahrenkrug et al. |
| 2014/0212869 A1 | 7/2014 | Sampas et al. |
| 2014/0227787 A1 | 8/2014 | Zhang |
| 2014/0234972 A1 | 8/2014 | Zhang |
| 2014/0242664 A1 | 8/2014 | Zhang et al. |
| 2014/0242699 A1 | 8/2014 | Zhang |
| 2014/0242700 A1 | 8/2014 | Zhang et al. |
| 2014/0242702 A1 | 8/2014 | Chen et al. |
| 2014/0248702 A1 | 9/2014 | Zhang et al. |
| 2014/0256046 A1 | 9/2014 | Zhang et al. |
| 2014/0271987 A1 | 9/2014 | Manoury et al. |
| 2014/0273037 A1 | 9/2014 | Wu |
| 2014/0273226 A1 | 9/2014 | Wu |
| 2014/0273230 A1 | 9/2014 | Chen et al. |
| 2014/0273231 A1 | 9/2014 | Zhang et al. |
| 2014/0273232 A1 | 9/2014 | Zhang et al. |
| 2014/0273234 A1 | 9/2014 | Zhang et al. |
| 2014/0273235 A1 | 9/2014 | Voytas et al. |
| 2014/0287938 A1 | 9/2014 | Zhang et al. |
| 2014/0294773 A1 | 10/2014 | Brouns et al. |
| 2014/0295556 A1 | 10/2014 | Joung et al. |
| 2014/0295557 A1 | 10/2014 | Joung et al. |
| 2014/0298547 A1 | 10/2014 | Sastry-Dent et al. |
| 2014/0304853 A1 | 10/2014 | Ainley et al. |
| 2014/0309487 A1 | 10/2014 | Lee et al. |
| 2014/0310828 A1 | 10/2014 | Lee et al. |
| 2014/0310830 A1 | 10/2014 | Zhang et al. |
| 2014/0315985 A1 | 10/2014 | May et al. |
| 2014/0335063 A1 | 11/2014 | Cannon et al. |
| 2014/0335620 A1 | 11/2014 | Zhang et al. |
| 2014/0349400 A1 | 11/2014 | Jakimo et al. |
| 2014/0356867 A1 | 12/2014 | Peter et al. |
| 2014/0356958 A1 | 12/2014 | Mali et al. |
| 2014/0357530 A1 | 12/2014 | Zhang et al. |
| 2014/0377868 A1 | 12/2014 | Joung et al. |
| 2015/0020223 A1 | 1/2015 | Zhang et al. |
| 2015/0024499 A1 | 1/2015 | Brouns et al. |
| 2015/0024500 A1 | 1/2015 | Yu et al. |
| 2015/0031134 A1 | 1/2015 | Zhang et al. |
| 2015/0044772 A1 | 2/2015 | Zhao |
| 2015/0045546 A1 | 2/2015 | Siksnys et al. |
| 2015/0050699 A1 | 2/2015 | Siksnys et al. |
| 2015/0056629 A1 | 2/2015 | Guthrie-Honea |
| 2015/0067922 A1 | 3/2015 | Yang et al. |
| 2015/0071899 A1 | 3/2015 | Liu et al. |
| 2015/0079681 A1 | 3/2015 | Zhang |
| 2015/0093473 A1 | 4/2015 | Barrangou et al. |
| 2015/0159174 A1 | 6/2015 | Frendeway et al. |
| 2015/0159175 A1 | 6/2015 | Frendeway et al. |
| 2015/0166969 A1 | 6/2015 | Takeuchi et al. |
| 2015/0167000 A1 | 6/2015 | Voytas et al. |
| 2015/0176064 A1 | 6/2015 | Fach et al. |
| 2015/0184139 A1 | 7/2015 | Zhang et al. |
| 2015/0191744 A1 | 7/2015 | Wolfe et al. |
| 2015/0203872 A1 | 7/2015 | Zhang |
| 2015/0232882 A1 | 8/2015 | Zhang et al. |
| 2015/0232883 A1 | 8/2015 | Dahlman et al. |
| 2015/0247150 A1 | 9/2015 | Zhang et al. |
| 2015/0252358 A1 | 9/2015 | Maeder et al. |
| 2015/0291965 A1 | 10/2015 | Zhang et al. |
| 2015/0315576 A1 | 11/2015 | Caliando et al. |
| 2015/0356239 A1 | 12/2015 | Zhang et al. |
| 2015/0376652 A1 | 12/2015 | Kuhn et al. |
| 2016/0010076 A1 | 1/2016 | Joung et al. |
| 2016/0010147 A1 | 1/2016 | Heron |
| 2016/0017301 A1 | 1/2016 | Khalili et al. |
| 2016/0017366 A1 | 1/2016 | Chen et al. |
| 2016/0024510 A1 | 1/2016 | Bikard et al. |
| 2016/0024523 A1 | 1/2016 | Joung et al. |
| 2016/0024524 A1 | 1/2016 | Joung et al. |
| 2016/0024529 A1 | 1/2016 | Carstens et al. |
| 2016/0362688 A1 | 12/2016 | May et al. |

FOREIGN PATENT DOCUMENTS

| | | |
|---|---|---|
| CN | 103343120 | 10/2013 |
| EP | 2325332 | 5/2011 |
| WO | WO 2003/072788 | 9/2003 |
| WO | WO 2004/099366 | 11/2004 |

(56) References Cited

FOREIGN PATENT DOCUMENTS

| | | |
|---|---|---|
| WO | WO 2007/014275 | 2/2007 |
| WO | WO 2007/025097 | 3/2007 |
| WO | WO 2008/108989 | 9/2008 |
| WO | WO 2010/054108 | 5/2010 |
| WO | WO 2011/017293 | 2/2011 |
| WO | WO 2011/143124 | 11/2011 |
| WO | WO 2012/093833 | 7/2012 |
| WO | WO 2012/164565 | 12/2012 |
| WO | WO 2013/012674 | 1/2013 |
| WO | WO 2013/098244 | 7/2013 |
| WO | WO 2013/141680 | 9/2013 |
| WO | WO 2013/142578 | 9/2013 |
| WO | WO 2013/169398 | 11/2013 |
| WO | WO 2013/176772 | 11/2013 |
| WO | WO 2014/0590255 | 4/2014 |
| WO | WO 2014/089290 | 6/2014 |
| WO | WO 2014/093655 | 6/2014 |
| WO | WO 2014/099744 | 6/2014 |
| WO | WO 2014/124284 | 8/2014 |
| WO | WO 2014/127287 | 8/2014 |
| WO | WO 2014/144288 | 9/2014 |
| WO | WO 2014/144592 | 9/2014 |
| WO | WO 2014/144761 | 9/2014 |
| WO | WO 2014/152432 | 9/2014 |
| WO | WO 2014/204578 | 12/2014 |
| WO | WO 2015/035162 | 3/2015 |
| WO | WO 2015/089364 | 6/2015 |
| WO | WO 2015/099850 | 7/2015 |
| WO | WO 2015/153940 | 10/2015 |
| WO | WO 2016/115355 | 6/2016 |

OTHER PUBLICATIONS

U.S. Appl. No. 61/799,647, filed Mar. 15, 2013, Joung et al.
U.S. Appl. No. 61/838,148, filed Jun. 21, 2013, Joung et al.
Addgene.org [Online]. CRISPR/Cas9 Guide on the web, Jan. 2016, [retrieved on Sep. 13, 2016]. Retrieved from the internet: URL<http://www.addgene.org/CRISPR/guide>/. 146 pages.
Appella, "Non-natural nucleic acids for synthetic biology", Current Opinion in Chemical Biology, Dec. 2009,13(5-6): 687-696.
Canadian Office Action in Canadian Application No. 2907198, dated Jul. 8, 2016, 4 pages.
European Partial Supplementary Search Report in European Application No. 14764117.9, dated Aug. 11, 2016, 7 pages.
European Search Report in European Application No. 14763916.5, dated Jul. 27, 2016, 10 pages.
Extended European Search Report in European Application No. 14764159.1, dated Aug. 10, 2016, 7 pages.
Extended European Search Report in European Application No. 14768877.4, dated Aug. 10, 2016, 10 pages.
Fu et al., "Targeted genome editing in human cells using CRISPR/Cas nucleases and truncated guide RNAs", Methods in Enzymology, Nov. 2014, 546: 21-45.
Gaj et al., "ZFN, TALEN, and CRISPR/Cas-based methods for genome engineering", Trends in Biotechnology, Jul. 2013, 31(7): 397-405.
International Preliminary Report on Patentability in International Application No. PCT/US2014/056416, dated Jun. 28, 2016, 7 pages.
International Search Report and Written Opinion in International Application No. PCT/US2013/074736, dated Sep. 17, 2014, 4 pages.
International Search Report in International Application No. PCT/US2014/054291, dated Mar. 27, 2015, 6 pages.
Invitation to Pay Additional Fees and, Where Applicable, Protest Fee in International Application No. PCT/US2016/49147, dated Oct. 31, 2016, 2 pages.
Karkare and Bhatnagar, "Promising nucleic acid analogs and mimics: characteristic features and applications of PNA, LNA, and morpholino", Applied Microbiology and Biotechnology, May 2006, 71(5): 575-586.
Slaymaker et al., "Rationally engineered Cas9 nucleases with improved specificity", Science, Dec. 2015, 351(6268): 84-88.
U.S. Final Office Action in U.S. Appl. No. 14/211,117, dated Jun. 30, 2016, 26 pages.
Al-Attar et al., "Clustered regularly interspaced short palindromic repeats (CRISPRs): the hallmark of an ingenious antiviral defense mechanism in prokaryotes," Biol Chem., Apr. 2011, 392:277-289.
Alexopoulou et al., "The CMV early enhancer/chicken β actin (CAG) promoter can be used to drive transgene expression during the differentiation of murine embryonic stem cells into vascular progenitors," BMC Cell Biology, 2008, 9:2.
Anders et al., "Structural basis of PAM-dependent target DNA recognition by the Cas9 endonuclease," Nature, 2014, 513:569-573.
Anonymous, "2013 Runners-Up. Genetic microsurgery for the masses," Science. Dec. 20, 2013;342(6165):1434-5.
Arimondo et al., "Exploring the Cellular Activity of Camptothecin—Triple—Helix-Forming Oligonucleotide Conjugates," Mol. Cell. Biol., 26(1):324-33 (2006).
Arnould et al., "Engineering of large numbers of highly specific homing endonucleases that induce recombination on novel DNA targets," J Mol Biol., 355(3):443-458, Epub Nov. 15, 2005.
Arnould et al., "The I-CreI meganuclease and its engineered derivatives: applications from cell modification to gene therapy," Protein Eng Des Sel., 24(1-2):27-31, Epub Nov. 3, 2010.
Arora et al., "Residues 1-254 of anthrax toxin lethal factor are sufficient to cause cellular uptake of fused polypeptides," J. Biol. Chem., Feb. 1993, 268:3334-41.
Auer et al., "Highly efficient CRISPR/Case9-mediated known-in in zebrafish by homology-independent DNA repair," Genome Res., 2014, 24:142-153.
Bae et al., "CAS-OFFinder: a fast and versatile algorithm that searches for potential off-target sites of Cas9 RNA-guided endonucleases," Bioinformatics, 2014, 30:1473-1475.
Bae et al., "Human zinc fingers as building blocks in the construction of artificial transcription factors," Nat Biotechnol., 21(3):275-280, Epub Feb. 18, 2003.
Barker et al., "Increased DNA microarray hybridization specificity using sscDNA targets," BMC Genomics, Apr. 2005, 6:57, 8 pages.
Baron-Benhamou et al., "Using the λ Peptide to Tether Proteins to RNAs," Methods Mole Biol., Jan. 2004, 257:135-153.
Barrangou & May, "Unraveling the potential of CRISPR-Cas9 for gene therapy," Expert Opin. Biol. Ther., 2015, 15:311-314.
Barrangou et al., "CRISPR Provides Acquired Resistance Against Viruses in Prokaryotes," Sci., 2007, 315:1709-1712.
Barrangou, "RNA-mediated programmable DNA cleavage," Nature Biotechnol., 2012, 30(9):836-838.
Bassett et al., "Highly efficient targeted mutagenesis of *Drosophila* with the CRISPR/Cas9 system," Cell Reports, 2013, 4:220-228.
Beerli and Barbas, "Engineering polydactyl zinc-finger transcription factors," Nat Biotechnol., 20(2):135-141, Feb. 2002.
Beerli et al., "Toward controlling gene expression at will: specific regulation of the erbB-2/HER-2 promoter by using polydactyl zinc finger proteins constructed from modular building blocks," PNAS USA, 1998, 95:14628-14633.
Belhaj et al., "Plant genome editing made easy: targeted mutagenesis in model and crop plants using the CRISPR/Cas system," Plant Methods, 2013, 9:39, 10 pages.
Bello et al., "Hypermethylation of the DNA repair gene MGMT: association with TP53 G:C to A:T transitions in a series of 469 nervous system tumors," Mutat. Res., Oct. 2004, 554:23-32.
Berg, "Proposed structure for the zinc-binding domains from transcription factor IIIA and related proteins," Proc Natl Acad Sci U S A., 85(1):99-102, Jan. 1988.
Bikard et al., "Programmable repression and activation of bacterial gene expression using an engineered CRISPR-Cas system," Nucleic Acid Res., Jun. 2013 41(15):7429-7437.
Bitinaite et al., "FokI dimerization is required for DNA cleavage," Proc. Natl. Acad. Sci. USA, 1998, 95:10570-10575.
Blackburn et al., "The CRISPR System-Keeping Zebrafish Gene Targeting Fresh," Zebrafish, 2013, 10(1):116-118.
Blaese et al., "T lymphocyte-directed gene therapy for ADA—SCID: initial trial results after 4 years," Science, Oct. 1995, 270:475-480.

(56) References Cited

OTHER PUBLICATIONS

Boch et al., "Breaking the code of DNA binding specificity of Tal-type III effectors," Science, Dec. 11, 2009;326(5959):1509-12.
Bogdanove & Voytas, "TAL Effectors: Customizable Proteins for DNA Targeting," Science, 333:1843-1846 (2011).
Bogdanove et al., "TAL effectors: finding plant genes for disease and defense," Curr. Opin. Plant Biol., 13:394-401 (2010).
Burgess, "A CRISPR genome-editing tool," Nature Reviews Genetics 14, 80-81 (Feb. 2013).
Burnett et al., "Conditional macrophage ablation in transgenic mice expressing a Fas-based suicide gene," J. Leukoc. Biol., Apr. 2004, 75(4):612-623.
Butler and Kadonaga, "The RNA polymerase II core promoter: a key component in the regulation of gene expression," Genes & Dev., 2002, 16:2583-2592.
Calbonetti et al., "Use of pertussis toxin vaccine molecule PT19K/129G to deliver peptide epitopes for stimulation of a cytotoxic T lymphocyte response," Abstr. Annu. Meet. Am. Soc. Microbiol., 1995, 95:295.
Carroll et al., "Design, construction and in vitro testing of zinc finger nucleases," Nat Protoc., 1(3):1329-1341, 2006.
Carroll, "A CRISPR Approach to Gene Targeting," Molecular Therapy, 2012, 20(9):1658-1660.
Carroll, "Progress and prospects: zinc-finger nucleases as gene therapy agents," Gene Ther., 15(22):1463-1468, Epub Sep. 11, 2008.
Carroll, "Staying on target with CRISPR-Case," Nat Biotechnol., 2013, 31(9):807-809.
Castellano et al., "Inducible recruitment of Cdc42 or WASP to a cell-surface receptor triggers actin polymerization and filopodium formation," Curr. Biol., 1999, 9(7): 351-360.
Cathomen and Joung, "Zinc-finger nucleases: the next generation emerges," Mol. Ther., 2008, 16:1200-1207.
Cermak et al., "Efficient design and assembly of custom TALEN and other TAL effector-based constructs for DNA targeting," Nucleic Acids Res., 39:e82, p. 1-11 (2011).
Chaikind et al., "Targeted DNA Methylation Using an Artificially Bisected M.HhaI Fused to Zinc Fingers," PLoS ONE, 7(9):E44852 pp. 1-11 (2012).
Chang et al., "Genome editing with RNA-guided Cas9 nuclease in zebrafish embryos," Cell Res., 2013, 23:465-472.
Chen & Zhao, "A highly sensitive selection method for directed evolution of homing endonucleases," Nucleic Acids Res., 2005, 33(18):e154.
Chen et al., "Cut Site Selection by the Two Nuclease Domains of the Cas9 RNA-guided Endonuclease," J Biol Chem. May 9, 2014; 289(19):13284-94.
Chen et al., "Dynamic imaging of genomic loci in living human cells by an optimized CRISPR/Cas system," Cell, 2013, 155(7):1479-1491.
Chen et al., "Efficient genome editing in Caenorhabditis elegans by CRISPR-targeted homologous recombination," Nucleic Acids Res., 2013, 41(20):e193, 6 pages.
Chen et al., "Induced DNA demethylation by targeting Ten-Eleven Translocation 2 to the human ICAM-1 promoter," Nucleic Acids Res., 42(3):1563-1574, Epub Nov. 4, 2013.
Cheng et al., "Multiplexed activation of endogenous genes by CRISPR-on, an RNA-guided transcriptional activator system," Cell Res., Oct. 2013, 23(10):1163-71.
Chim et al., "Methylation profiling in multiple myeloma," Leuk. Res., Apr. 2004, 28:379-85.
Chiu et al., "Transgene-free genome editing in Caenorhabditis elegans using CRISPR-Cas," Genetics, Nov. 2013, 195(3):1167-71.
Cho et al., "Analysis of off-target effects of CRISPR/Case-derived RNA-guided endonucleases and nickases," Genome Res., 2014, 24:132-141.
Cho et al., "Targeted genome engineering in human cells with the Cas9 RNA-guided endonuclease," Nat Biotechnol., 2013, 31:230-232.
Choo and Klug, "Toward a code for the interactions of zinc fingers with DNA: selection of randomized fingers displayed on phage," Proc Natl Acad Sci U S A., 91(23):11163-11167, Nov. 8, 1994.
Christian et al., "Targeting DNA Double-Strand Breaks with TAL Effector Nucleases," Genetics, 2010, 186:757-761 (2010).
Chylinski et al., "Classification and evolution of type II CRISPR-Cas systems," Nucleic Acids Res. 2014;42(10):6091-105.
Chylinski et al., "The tracrRNA and Cas9 families of type II CRISPR-Cas immunity systems," RNA Biol., 2013, 10(5):726-737.
Clark-Curtiss and Curtiss, "[23] Analysis of recombinant DNA using *Escherichia coli* minicells," Methods in Enzymology, 1983, 101:347-362.
Colley et al., "Conversion of a Golgi Apparatus Sialyltransferase to a Secretory Protein by Replacement of the NH2-terminall Signal Anchor with a Signal Peptide," J. Biol. Chem., 1989, 264:17619-22.
Cong et al., "Multiplex genome engineering using CRISPR/Cas systems," Science, 2013, 339:819-823 (Author Manuscript).
Conklin, "Sculpting genomes with a hammer and chisel," Nature Methods, 2013, 10(9):839-840.
Costa et al., "REELIN and schizophrenia: a disease at the interface of the genome and the epigenome," Mol. Interv., Feb. 2002, 2:47-57.
Crabtree and Schreiber, "Three-part inventions: intracellular signaling and induced proximity," Trends Biochem. Sci., Nov. 1996, 21(11):418-422.
Cradick et al., "CRISPR/Cas9 systems targeting beta-globin and CCR5 genes have substantial off-target activity," Nucleic Acids Res., 2013, 41(20):9584-92.
D'Avignon et al., "Site-specific experiments on folding/unfolding of Jun coiled coils: thermodynamic and kinetic parameters from spin inversion transfer nuclear magnetic resonance at leucine-18," Biopolymers, 83(3):255-267, Oct. 15, 2006.
De Souza, "RNA-guided gene editing," Nat Methods, Mar. 2013, 10(3):189.
De Zhu, "The altered DNA methylation pattern and its implications in liver cancer," Cell. Res., 2005, 15:272-80.
Deltcheva et al., "CRISPR RNA maturation by trans-encoded small RNA and host factor Rnase III," Nature, 2011, 471(7340):602-607 (Author Manuscript).
Deveau et al., "Phage response to CRISPR-encoded resistance in *Streptococcus thermophilus*," J Bacteriol., Feb. 2008, 190(4):1390-400.
Dicarlo et al., "Genome engineering in *Saccharomyces cerevisiae* using CRISPR-Cas systems," Nucleic Acids Res., 2013, 41(7):4336-43.
Dickinson et al., "Engineering the Caenorhabditis elegans genome using Cas9-triggered homologous recombination," Nat Methods., Oct. 2013, 10(10):1028-34.
Ding et al., "Enhanced efficiency of human pluripotent stem cell genome editing through replacing TALENs with CRISPRs," Cell Stem Cell., Apr. 4, 2013, 12(4):393-4 (Author Manuscript).
Donnelly et al., "Targeted delivery of peptide epitopes to class I major histocompatibility molecules by a modified Pseudomonas exotoxin," PNAS, Apr. 1993, 90:3530-34.
Doudna and Charpentier, "Genome editing. The new frontier of genome engineering with CRISPR-Cas9," Science, Nov. 2014, 346:1258096, 11 pages.
Doyon et al., "Directed Evolution and Substrate Specificity Profile of Homing Endonuclease I-Scel," J. Am. Chem. Soc., 2006, 128:2477-2484.
Doyon et al., "Heritable targeted gene disruption in zebrafish using designed zinc-finger nucleases," Nat Biotechnol., Jun. 2008, 26:702-708.
Dranoff et al., "A phase I study of vaccination with autologous, irradiated melanoma cells engineered to secrete human granulocyte-macrophage colony stimulating factor," Hum. Gene Ther., Jan. 1997, 8(1):111-23.
Dunbar et al., "Retrovirally Marked CD34-Enriched Peripheral Blood and Bone Marrow Cells Contribute to Long-Term Engraftment After Autologous Transplantation ," Blood, Jun. 1995, 85:3048-3057.

(56) References Cited

OTHER PUBLICATIONS

Eisenschmidt et al., "Developing a programmed restriction endonuclease for highly specific DNA cleavage," Nucleic Acids Res., 33(22):7039-47 (2005).
Ellem et al., "A case report: immune responses and clinical course of the first human use of granulocyte/macrophage-colony-stimulating-factor-transduced autologous melanoma cells for immunotherapy," Immunol Immunother., Mar. 1997, 44:10-20.
Elrod-Erickson et al., "High-resolution structures of variant Zif268-DNA complexes: implications for understanding zinc finger-DNA recognition," Structure, 6(4):451-464, Apr. 15, 1998.
Esteller et al., "A Gene Hypermethylation Profile of Human Cancer," Cancer Res., Apr. 2001, 61:3225-9.
Esteller et al., "Promoter Hypermethylation and BRCA1 Inactivation in Sporadic Breast and Ovarian Tumors," J. Natl. Cancer Inst., Apr. 2000, 92:564-9.
Esvelt et al., "Orthogonal Cas9 proteins for RNA-guided gene regulation and editing," Nat Methods, Nov. 2013, 10(11):1116-21.
Fisher et al., "A scalable, fully automated process for construction of sequence-ready human exome targeted capture libraries," Genome Biol., 2011, 12-R1.
Fonfara et al., "Phylogeny of Cas9 determines functional exchangeability of dual-RNA and Cas9 among orthologous type II CRISPR-Cas systems." Nucleic Acids Res., Feb. 2014, 42(4):2577-90.
Freeman et al., "Inducible Prostate Intraepithelial Neoplasia with Reversible Hyperplasia in Conditional FGFR1-Expressing Mice," Cancer Res., Dec. 2003, 63(23):8256-8563.
Friedland et al., "Heritable genome editing in C. elegans via a CRISPR-Cas9 system," Nature Methods 10(8): 741-743, 2013 (Author Manuscript).
Fu et al., "High-frequency off-target mutagenesis induced by CRISPR-Cas nucleases in human cells," Nat Biotechnol., 2013, 31:822-826 (Author Manuscript).
Fu et al., "Improving CRISPR-Cas nuclease specificity using truncated guide RNAs," Nat. Biotechnol. Mar. 2014, 32:279-284.
Gabriel et al., "An unbiased genome-wide analysis of zinc-finger nuclease specificity," Nat Biotechnol., 2011, 29:816-823.
Gagnon et al., "Efficient mutagenesis by Cas9 protein-mediated oligonucleotide insertion and large-scale assessment of single-guide RNAs," PLoS One, May 2014, 9, e98186.
Gao et al., "Hypermethylation of the RASSF1A gene in gliomas," Clin. Chim. Acta., Nov. 2004, 349:173-9.
Garcia-Bustos et al., "Nuclear protein localization," Biochim. Biophys. Acta, Mar. 1991, 1071:83-101.
Garneau et al., "The CRISPR/Cas bacterial immune system cleaves bacteriophage and plasmid DNA," Nature, Nov. 4, 2010, 468(7320):67-71.
Gasiunas and Siksnys,"RNA-dependent DNA endonuclease Cas9 of the CRISPR system: Holy Grail of genome editing?" Trends Microbiol., 2013, 21(11):562-567.
Gasiunas,"Cas9-crRNA ribonucleoprotein complex mediates specific DNA cleavage for adaptive immunity in bacteria," Proc Natl Acad Sci U S A, Sep. 25, 2012, 109(39):E2579-86.
Geibler et al., "Transcriptional Activators of Human Genes with Programmable DNA-Specificity ," PLoS ONE, 6:e19509 (2011).
Gilbert et al., "CRISPR-mediated modular RNA-guided regulation of transcription in eukaryotes," Cell, 2013, 154(2):442-51.
Gossen and Bujard, "Tight control of gene expression in mammalian cells by tetracycline-responsive promoters," Proc. Natl. Acad. Sci., Jun. 1992, 89:5547-5551.
Graef et al., "Proximity and orientation underlie signaling by the non-receptor tyrosine kinase ZAP70," Embo. J., 1997, 16(18):5618-5628.
Gratz et al., "CRISPR/Cas9-mediated genome engineering and the promise of designer flies on demand," Fly (Austin), Oct.-Dec. 2013, 7(4):249-55.
Gratz et al., "Genome engineering of Drosophila with the CRISPR RNA-guided Cas9 nuclease," Genetics, 2013, 194(4):1029-35.
Grizot et al., "Generation of redesigned homing endonucleases comprising DNA-binding domains derived from two different scaffolds," Nucleic Acids Res., 38(6):2006-2018, Epub Dec. 21, 2009.
Gross and Garrard, "Nuclease Hypersensitive Sites in Chromatin," Annu. Rev. Biochem., Jul. 1988, 57:159-97.
Guilinger et al., "Broad specificity profiling of TALENs results in engineered nucleases with improved DNA-cleavage specificity," Nat. Methods, Apr. 2014, 11:429-435.
Guilinger et al., "Fusion of catalytically inactive Cas9 to FokI nuclease improves the specificity of genome modification," Nat Biotechnol., Apr. 2014, 32(6):577-583.
Guo et el., "Hydroxylation of 5-Methylcytosine by TET1 Promotes Active DNA Demethylation in the Adult Brain ," Cell, 145:423-434 (2011).
Haft et al., "A Guild of 45 CRISPR-Associated (Cas) Protein Families and multiple CRISPR/cas Subtypes Exist in Prokaryotic Genomes," PLOS, 2005, 1(6):0474-0483.
Hale et al., "Essential features and rational design of CRISPR RNAs that function with the Case RAMP modlule complex to cleave RNAs," Mol Cell., 2012, 45(3):292-302 (Author Manuscript).
Han et al., "CTCF is the Master Organizer of Domain-Wide Allele-Specific Chromatin at the H19/Igf2 Imprinted Region," Mol Cell Biol., Feb. 2008, 28(3):1124-35.
Han et al., "Ligand-directed retroviral targeting of human breast cancer cells," PNAS, Oct. 1995, 92:9747-51.
Harikrishna et al., "Construction and function of fusion enzymes of the human cytochrome P450scc system," DNA Cell Biol., 12(5):371-379, Jun. 1993.
Harrison, "A structural taxonomy of DNA-binding domains," Nature, 353(6346): 715-719, Oct. 24, 1991.
Haurwitz et al., "Sequence- and Structure-Specific RNA Processing by a CRISPR Endonuclease," Science, Sep. 2010, 329(5997):1355-8.
Haurwitz, R. "The CRISPR endoribonuclease Csy4 utilizes unusual sequence- and structure-specific mechanisms to recognize and process crRNAs," Thesis. May 8, 2012 (May 8, 2012), University of California, Berkeley, pp. 1-120. Retrieved from the Internet:<http://escholarship.org/uc/item/0rh5940p> on Dec. 26, 2014 (Dec. 26, 2014). entire document.
He et al., "Tet-Mediated Formation of 5-Carboxylcytosine and Its Excision by TDG in Mammalian DNA," Science, 333:1303-1307 (2011).
Hockemeyer et al., "Genetic engineering of human ES and iPS cells using TALE nucleases," Nat Biotechnol., 2011, 29:731-734 (Author Manuscript).
Horii et al., "Generation of an ICF Syndrome Model by Efficient Genome Editing of Human Induced Pluripotent Stem Cells using the CRISPR System," Int J Mol Sci., 2013, 14:19774-19781.
Horvath and Barrangou, "CRISPR/Cas, the immune system of bacteria and archaea," Science, 2010, 327:167-170.
Horvath et al., "Diversity, activity, and evolution of CRISPR loci in Streptococcus thermophilus," J. Bacteriol., Feb. 2008, 190:1401-1412.
Hou et al., "Efficient genome engineering in human pluripotent stem cells using Cas9 from Neisseria meningitidis," Proc Natl Acad Sci U S A, Sep. 24, 2013, 110(39):15644-9.
Hsu et al., "Development and Applications of CRISPR-Cas9 for Genome Engineering," Cell, 2014, 157(6):1262-1278.
Hsu et al., "DNA targeting specificity of RNA-guided Cas9 nucleases," Nat Biotechnol., 2013, 31:827-832.
Huang et al., "Heritable gene targeting in zebrafish using customized TALENs," Nat. Biotechnol., 29:699-700 (2011).
Hwang et al., "Efficient In Vivo Genome Editing Using RNA-Guided Nucleases," Nat Biotechnol., 2013, 31:227-229 (Author Manuscript).
Hwang et al., "Heritable and Precise Zebrafish Genome Editing Using a CRISPR-Cas System," PLoS One, 2013, 8(7):e68708, 9 pages.
International Preliminary Report on Patentability in International Application No. PCT/US2013/043075, dated Dec. 2, 2014, 7 pages.
International Preliminary Report on Patentability in International Application No. PCT/US2014/027335, dated Sep. 15, 2015, 10 pages.

(56) References Cited

OTHER PUBLICATIONS

International Preliminary Report on Patentability in International Application No. PCT/US2014/028630, dated Sep. 15, 2015, 8 pages.
International Preliminary Report on Patentability in International Application No. PCT/US2014/029068, dated Sep. 15, 2015, 10 pages.
International Preliminary Report on Patentability in International Application No. PCT/US2014/029304, dated Sep. 22, 2015, 12 pages.
International Search Report and Written Opinion in International Application No. PCT/US2013/043075, dated Sep. 26, 2013, 10 pages.
International Search Report and Written Opinion in International Application No. PCT/US2014/027335, dated Jul. 16, 2014, 13 pages.
International Search Report and Written Opinion in International Application No. PCT/US2014/028630, dated Jul. 24, 2014, 9 pages.
International Search Report and Written Opinion in International Application No. PCT/US2014/029068, dated Nov. 5, 2014, 15 pages.
International Search Report and Written Opinion in International Application No. PCT/US2014/029304, dated Nov. 14, 2014, 17 pages.
International Search Report and Written Opinion in International Application No. PCT/US2014/035162, dated Oct. 14, 2014, 10 pages.
International Search Report and Written Opinion in International Application No. PCT/US2014/056416, dated Apr. 3, 2015, 11 pages.
Invitation to Pay Additional Fees and, Where Applicable, Protest Fee in International Application No. PCT/US2014/029068, dated Aug. 20, 2014, 3 pages.
Invitation to Pay Additional Fees and, Where Applicable, Protest Fee in International Application No. PCT/US2014/029304, mailed Jul. 30, 2014, 3 pages.
Isalan et al., "A rapid, generally applicable method to engineer zinc fingers illustrated by targeting the HIV-1 promoter," Nat. Biotechnol., 19(7):656-660, Jul. 2001.
Ishino et al., "Nucleotide sequence of the iap gene, responsible for alkaline phosphatase isozyme conversion in *Escherichia coli*, and identification of the gene product," J Bacteriol., Dec. 1987, 169(12):5429-33.
Ito et al., "Tet proteins can convert 5-methylcytosine to 5-formylcytosine and 5-carboxylcytosine," Science, 333(6047):1300-1303, Sep. 2, 2011.
Iyer et al., "Prediction of novel families of enzymes involved in oxidative and other complex modifications of bases in nucleic acids," Cell Cycle, Jun. 1, 2009, 8(11):1698-710.
Iyer et al., Supplementary Material for "Prediction of novel families of enzymes involved in oxidative and other complex modifications of bases in nucleic acids," Cell Cycle, Jun. 1, 2009, 8(11):1698-710, [retrieved on Dec. 22, 2015]. Retrieved from the Internet: URL <ftp://ftp.ncbi.nih.gov/pub/aravind/DONS/supplementary_material_DONS.html>.
Jamieson et al., "In vitro selection of zinc fingers with altered DNA-binding specificity," Biochemistry, 33(19):5689-5695, May 17, 1994.
Jansen et al., "Identification of genes that are associated with DNA repeats in prokaryotes," Mol Microbiol., Mar. 2002, 43(6):1565-75.
Jiang et al., "CRISPR-assisted editing of bacterial genomes," Nat Biotechnol., 2013, 31:233-239 (Author Manuscript).
Jiang et al., "Structural Biology. A Cas9-guide RNA complex preorganized for target DNA recognition," Science, Jun. 2015, 348:1477-1481.
Jinek et al., "A programmable dual-RNA-guided DNA endonuclease in adaptive bacterial immunity," Science, 2012, 337:816-821.
Jinek et al., "RNA-programmed genome editing in human cells," Elife, 2013, 2:e00471, 9 pages.
Jinek et al., "Structures of Cas9 Endonucleases Reveal RNA-Mediated Conformational Activation," Science. Mr. 14, 2014; 343(6176):1247997.
Josephs et al., "Structure and specificity of the RNA-guided endonuclease Cas9 during DNA interrogation, target binding and cleavage," Nucleic Acids Res., Sep. 2015, 43:8924-8941.
Joung and Sander, "TALENs: a widely applicable technology for targeted genome editing," Nat Rev Mol Cell Biol., 14(1):49-55, Epub Nov. 21, 2012.
Joung et al., "Reply to "Successful genome editing with modularly assembled zinc finger nucleases"," Nat. Methods, Jan. 2010, 7:91-92.
Karmirantzou and Harnodrakas, "A Web-based classification system of DNA-binding protein families," Protein Eng. 14(7):465-472, Jul. 2001.
Karvelis et al., "crRNA and tracrRNA guide Cas9-mediated DNA interference in *Streptococcus thermophilus*," RNA Biol., 2013, 10(5):841-851.
Katic and Großhans, "Targeted heritable mutation and gene conversion by Cas9-CRISPR in Caenorhabditis elegans," Genetics, Nov. 2013, 195(3):1173-6.
Kearns et al., "Recombinant adeno-associated virus (AAV-CFTR) vectors do not integrate in a site-specific fashion in an immortalized epithelial cell line," Gene Ther., Sep. 1996, 9:748-55.
Keryer-Bibens et al., "Tethering of proteins to RNAs by bacteriophage proteins," Biol Cell, 2008, 100:125-138.
Kiani et al., "Cas9 gRNA engineering for genome editing, activation and repression," Nat. Methods, 2015, 12:1051-1054.
Kim and Kim, "A guide to genome engineering with programmable nucleases," Nature Rev Genetics 15, 321-334 (2014).
Kim et al., "Highly efficient RNA-guided genome editing in human cells via delivery of purified Cas9 ribonucleoproteins," Genome Res. Jun. 2014; 24(6):1012-9.
Kim et al., "Targeted genome editing in human cells with zinc finger nucleases constructed via modular assembly," Genome Res., 19(7):1279-1288, Epub May 21, 2009.
Kim et al., "Genome editing with modularly assembled zinc-finger nucleases," Nat. Methods, 7(2):91-92, Feb. 2010.
Kleinstiver et al., "A unified genetic, computational and experimental framework identifies functionally relevant residues of the homing endonuclease I-BmoI," Nucleic Acids Res., 2010, 38:2411-2427.
Kleinstiver et al., "Engineered CRISPR-Cas9 nucleases with altered PAM specificities," Nature, Jul. 2015, 523(7561):481-5.
Klimpel et al., "Anthrax toxin protective antigen is activated by a cell surface protease with the sequence specificity and catalytic properties of furin," PNAS, Nov. 1992, 89:10277-81.
Klug, "Co-chairman's remarks: protein designs for the specific recognition of DNA," Gene, 135(1-2):83-92, Dec. 15, 1993.
Koike-Yusa et al., "Genome-wide recessive genetic screening in mammalian cells with a lentiviral CRISPR-guide RNA library," Nat Biotechnol., Mar. 2014, 32(3):267-73.
Kondo and Ueda, "Highly improved gene targeting by germline-specific Cas9 expression in *Drosophila*," Genetics, Nov. 2013, 195(3):715-21.
Konermann et al., "Optical control of mammalian endogenous transcription and epigenetic states," Nature. Aug. 22, 2013; 500(7463):472-6. (Author Manuscript).
Kumar et al., "DNA-Prot: identification of DNA binding proteins from protein sequence information using random forest," J Biomol Struct Dyn., 26(6):679-686, Jun. 2009.
Kumar et al., "Identification of DNA-binding proteins using support vector machines and evolutionary profiles," BMC Bioinformatics, 8:463, Nov. 27, 2007.
Kummerfeld and Teichmann, "DBD: a transcription factor prediction database," Nucleic Acids Res., 34 (Database issue): D74-D81, Jan. 1, 2006.
Kurmasheva et al., "Upstream CpG island methylation of the PAX3 gene in human rhabdomyosarcomas," Pediatr. Blood Cancer, Apr. 2005, 44:328-37.
Lea et al., "Aberrant p16 methylation is a biomarker for tobacco exposure in cervical squamous cell carcinogenesis," Am. J. Obstet. Gynecol., 2004, 190:674-9.

(56) References Cited

OTHER PUBLICATIONS

Lee et al., "Three-dimensional solution structure of a single zinc finger DNA-binding domain," Science., 245(4918):635-637, Aug. 11, 1989.
Li et al., "DNA methylation in prostate cancer," Biochim. Biophys. Acta., Sep. 2004, 1704:87-102.
Li et al., "Heritable gene targeting in the mouse and rat using a CRISPR-Cas system," Nat Biotechnol, Aug. 2013, 31(8):681-3.
Li et al., "Modularly assembled designer TAL effector nucleases for targeted gene knockout and gene replacement in eukaryotes," Nucleic Acids Res., 39(14):6315-6325, Epub Mar. 31, 2011.
Li et al., "Protein trans-splicing as a means for viral vector-mediated in vivo gene therapy," Hum Gene Ther., 19(9):958-964, Sep. 2008.
Li et al., "Simultaneous generation and germline transmission of multiple gene mutations in rat using CRISPR-Cas systems," Nat Biotechnol., Aug. 2013, 31(8):684-6.
Li et al., "TAL nucleases (TALNs): hybrid proteins composed of TAL effectors and FokI DNA-cleavage domain," Nucleic Acids Res., 2011, 39(1): 359-372.
Lin et al., "CRISPR/Cas9 systems have off-target activity with insertions or deletions between target DNA and guide RNA sequences," Nucleic Acids Res., 2014, 42:7473-7485.
Lin et al., "iDNA-Prot: identification of DNA binding proteins using random forest with grey model," PLoS One., 6(9):e24756, Epub Sep. 15, 2011.
Liu et al., "Regulation of an Endogenous Locus Using a Panel of Designed Zinc Finger Proteins Targeted to Accessible Chromatin Regions," J. Biol. Chem., Apr. 2001, 276(14):11323-34.
Liu et al., "Validated zinc finger protein designs for all 16 GNN DNA triplet targets," J. Biol. Chem., 277(6):3850-3856, Epub Nov. 28, 2001.
Lo et al., "Precise and Heritable Genome Editing in Evolutionarily Diverse Nematodes Using TALENs and CRISPR/Cas9 to Engineer Insertions and Deletions," Genetics, 2013, 195:331-348.
Lund et al., "DNA Methylation Polymorphisms Precede Any Histological Sign of Atherosclerosis in Mice Lacking Apolipoprotein E," J. Biol. Chem., Jul. 2004, 279:29147-54.
Mabaera et al., "Developmental- and differentiation-specific patterns of human γ- and β-globin promoter DNA methylation," Blood, 110(4):1343-52 (2007).
Maeder et al., "CRISPR RNA-guided activation of endogenous human genes," Nat Methods, 2013, 10:977-979 (Author Manuscript).
Maeder et al., "Rapid 'open-source' engineering of customized zinc-finger nucleases for highly efficient gene modification," Mol Cell, 2008, 31(2):294-301.
Maeder et al., "Robust, synergistic regulation of human gene expression using TALE activators," Nat. Methods, 2013, 10:243-245.
Maeder et al., "Targeted DNA demethylation and activation of endogenous genes using programmable TALE-TET1 fusion proteins," Nat Biotechnol., 31(12):1137-1142, [author manuscript] Epub Oct. 9, 2013.
Mahfouz et al., "De novo-engineered transcription activator-like effector (TALE) hybrid nuclease with novel DNA binding specificity creates double-strand breaks," Proc Natl Acad Sci U S A, 108:2623-2628 (2011).
Maiti and Drohat, "Thymine DNA glycosylase can rapidly excise 5-formylcytosine and 5-carboxylcytosine: potential implications for active demethylation of CpG sites," J Biol Chem., 286(41):35334-35338, Epub Aug. 23, 2011.
Majumdar et al., "Targeted Gene Knock in and Sequence Modulation Mediated by a Psoralen-linked Triplex-forming Oligonucleotide," J Biol Chem., 283(17):11244-52 (2008).
Makarova et al., "A putative RNA-interference-based immune system in prokaryotes: computational analysis of the predicted enzymatic machinery, functional analogies with eukaryotic RNAi, and hypothetical mechanisms of action," Biol. Direct, 2006, 1:7, 26 pages.

Makarova et al., "Evolution and classification of the CRISPR-Cas systems," Nat. Rev. Microbiol., 2011, 9(6):467-77 (Author Manuscript).
Makarova et al., "Unification of Cas protein families and a simple scenario for the origin and evolution of CRISPR-Cas systems," Biol. Direct, 2011, 6:38, 27 pages.
Malech et al., "Prolonged production of NADPH oxidase-corrected granulocytes after gene therapy of chronic granulomatous disease," PNAS, Oct. 1997, 94:12133-38.
Mali et al., "Cas9 as a versatile tool for engineering biology," Nature Methods, 2013, 10(10):957-963.
Mali et al., "CAS9 transcriptional activators for target specificity screening and paired nickases for cooperative genome engineering," Nat Biotechnol., 2013, 31:833-838.
Mali et al., "RNA-guided human genome engineering via Cas9," Science, Feb. 2013, 339:823-826 (Author Manuscript).
Mancini et al. "CpG methylation within the 5' regulatory region of the BRCA1 gene is tumor specific and includes a putative CREB binding site," Oncogene, 1998, 16:1161-9.
Mandell and Barbas et al., "Zinc Finger Tools: custom DNA-binding domains for transcription factors and nucleases," Nucleic Acids Res., 34(Web Server issue):W516-W523, Jul. 1, 2006.
Marraffini and Sontheimer, "CRISPR Interference Limits Horizontal Gene Transfer in Staphylococci by Targeting DNA," Sci., 2008, 322(5909):1843-1845.
Marraffini and Sontheimer, "Self vs. non-self discrimination during CRISPR RNA-directed immunity," Nature, 2010, 463(7280):568-571 (Author Manuscript).
Mashiko et al., "Generation of mutant mice by pronuclear injection of circular plasmid expressing Cas9 and single guided RNA," Sci Reports, 2013, 3(3355):1-6.
McGarty, "CRISPRs and Cancer," White Paper No. 111, Apr. 2014, 22 pages.
Mendenhall et al., "Locus-specific editing of histone modifications at endogenous enhancers," Nat Biotechnol., 31(12):1133-1136, Epub Sep. 8, 2013.
Miller et al., "A TALE nuclease architecture for efficient genome editing," Nature Biotechnology, Feb. 2011, 29:143-148.
Miller et al., "An improved zinc-finger nuclease architecture for highly specific genome editing," Nat Biotechnol., 2007, 25:778-785.
Miller et al., "Repetitive zinc-binding domains in the protein transcription factor IIIA from Xenopus oocytes," EMBO J., 4(6):1609-1614, Jun. 1985.
Miyazaki et al., "Expression vector system based on the chicken beta-actin promoter directs efficient production of interleukin-5," Gene, Jul. 1989, 79(2):269-77.
Mojica et al., "Biological significance of a family of regularly spaced repeats in the genomes of Archaea, Bacteria and mitochondria," Mol Microbiol., Apr. 2000, 36(1):244-6.
Mojica et al., "Short motif sequences determine the targets of the prokaryotic CRISPR defense system," Microbiology, 2009, 155:733-740.
Moore et al., "Design of polyzinc finger peptides with structured linkers," Proc Natl Acad Sci USA, Feb. 2001, 98:1432-1436.
Morbitzer et al., "Regulation of selected genome loci using de novo-engineered transcription activator-like effector (TALE)-type transcription factors," Proc Natl Acad Sci U S A., 107(50):21617-21622, Epub Nov. 24, 2010.
Morbitzer et al., "Assembly of custom TALE-type DNA binding domains by modular cloning," Nucl Acids Res., 39:5790-5799 (2011).
Morrison, "Transformation in Escherichia coli: Cryogenic Preservation of Competent Cells," J. Bacteriol., Oct. 1977, 132:349-351.
Moscou and Bogdanove, "A simple cipher governs DNA recognition by TAL effectors," Science, 326(5959):1501, Dec. 11, 2009.
Mussolino and Cathomen, "RNA guides genome engineering," Nat Biotechnol., 2013, 31(3):208-209.
Mussolino et al., "A novel TALE nuclease scaffold enables high genome editing activity in combination with low toxicity," Nucleic Acids Res., 2011, 39:9283-93.

(56) References Cited

OTHER PUBLICATIONS

Muthuswamy et al., "Controlled Dimerization of ErbB Receptors Provides Evidence for Differential Signaling by Homo- and Heterodimers," Mol. Cell. Biol., Oct. 1999, 19(10):6845-6857.
Needleman and Wunsch, "A General Method Applicable to the Search for Similarities in the Amino Acid Sequence of Two Proteins," J. Mol. Biol., 1970, 48:444-453.
Neering et al., "Transduction of Primitive Human Hematopoietic Cells With Recombinant Adenovirus Vectors," Blood, Aug. 1996, 88:1147-55.
Nishimasu et al., "Crystal structure of Cas9 in complex with guide RNA and target DNA," Cell, 2014, 156:935-949.
Nissim et al., "Multiplexed and Programmable Regulation of Gene Networks with an Integrated RNA and CRISPR/Cas Toolkit in Human Cells," Molecular Cell, May 2014, 54:698-710.
Niu et al., "Generation of gene-modified cynomolgus monkey via Cas9/RNA-mediated gene targeting in one-cell embryos," Cell, 2014, 156:836-843.
Niwa et al., "Efficient selection for high-expression transfectants with a novel eukaryotic vector," Gene, 1991, 108(2):193-9.
Novak et al., "Functional Characterization of Protease-treated Bacillus anthracis Protective Antigen," J. Biol. Chem., Aug. 1992, 267:17186-93.
Oligino et al., "Drug inducible transgene expression in brain using a herpes simplex virus vector," Gene Ther., 1998, 5:491-496.
Palva et al., "Secretion of interferon by Bacillus subtilis," Gene, 1983, 22:229-235.
Pattanayak et al., "High-throughput profiling of off-target DNA cleavage reveals RNA-programmed Cas9 nuclease specificity," Nat Biotechnol., 2013, 31:839-843 (Author Manuscript).
Pattanayak et al., "Revealing off-target cleavage specificities of zinc-finger nucleases by in vitro selection," Nat Methods, 2011, 8:765-770 (Author Manuscript).
Pavletich and Pabo, "Zinc finger-DNA recognition: crystal structure of a Zif268-DNA complex at 2.1 A," Science, 252(5007):809-817, May 10, 1991.
Perelle et al., "Characterization of Clostridium perfringens Iota-Toxin Genes and Expression in *Eschenichia coli*," Infect. Immun., Dec. 1993, 61:5147-56.
Perez et al., "Establishment of HIV-1 resistance in CD4+ T cells by genome editing using zinc-finger nucleases," Nat Biotechnol., 2008, 26:808-816 (Author Manuscript).
Perez-Pinera et al., "RNA-guided gene activation by CRISPR-Case9-based transcription factors," Nat Methods, 2013, 10(10):973-976 (Author Manuscript).
Pingoud and Silva, "Precision genome surgery," Nat Biotechnol., 25(7):743-744, Jul. 2007.
Puchta and Fauser et al., "Synthetic nucleases for genome engineering in plants: prospects for a bright future," Plant J., Jun. 2014, 78(5):727-41.
Qi et al., "Repurposing CRISPR as an RNA-Guided Platform for Sequence-Specific Control of Gene Expression," Cell, Feb. 2013, 152:1173-1183.
Ramakrishna et al., "Gene disruption by cell-penetrating peptide-mediated delivery of Cas9 protein and guide RNA," Genome Res. Jun. 2014; 24(6): 1020-1027.
Ramakrishna et al., "Surrogate reporter-based enrichment of cells containing RNA-guided Cas9 nuclease-induced mutations," Nat Commun. Feb. 26, 2014; 5:3378.
Ramalingam et al., "A CRISPR way to engineer the human genome," Genome Biol., 2013, 14:107, 4 pages.
Ramirez et al., "Unexpected failure rates for modular assembly of engineered zinc fingers," Nat Methods., 5(5):374-375, May 2008.
Ran et al., "Double nicking by RNA-guided CRISPR Cas9 for enhanced genome editing specificity," Cell, 2013, 154:1380-1389.
Ran et al., "Genome engineering using the CRISPR-Cas9 system," Nature Protocols, 2013, 8(11):2281-2308.
Ran et al., "In vivo genome editing using *Staphylococcus aureus* Cas9," Nature, 2015, 520:186-191.

Rebar and Pabo, "Zinc finger phage: affinity selection of fingers with new DNA-binding specificities," Science, 263(5147):671-673, Feb. 4, 1994.
Ren et al., "Optimized gene editing technology for *Drosophila melanogaster* using germ line-specific Cas9," Proc Natl Acad Sci U S A, Nov. 19, 2013, 110(47):19012-7.
Rendahl et al., "Regulation of gene expression in vivo following transduction by two separate rAAV vectors," Nat. Biotechnol., Aug. 1998, 16:757-761.
Reyon et al., "FLASH assembly of TALENs for high-throughput genome editing," Nat Biotech, 2012, 30:460-465 (Author Manuscript).
Ro et al., "Adenovirus-based short hairpin RNA vectors containing an EGFP marker and mouse U6, human H1, or human U6 promoter," BioTechniques, 2005, 38(4):625-627.
Rodenhiser and Mann, "Epigenetics and human disease: translating basic biology into clinical applications," CMAJ, 174(3):341-348 (2006).
Rohde et al., "BISMA—Fast and accurate bisulfite sequencing data analysis of individual clones from unique and repetitive sequences," BMC Bioinformatics, 11:230 12 pages (2010).
Rothman, "Mechanisms of intracellular protein transport," Nature, 372(6501):55-63, Nov. 3, 1994.
Rusk, "CRISPRs and epigenome editing," Nature Methods, 2014, 11(1):28.
Sander and Joung et al., "CRISPR-Cas systems for editing, regulating and targeting genomes," Nat Biotechnol., Apr. 2014, 32(4):347-55.
Sander et al., "In silico abstraction of zinc finger nuclease cleavage profiles reveals an expanded landscape of off-target sites," Nucleic Acids Res., 2013, 41:e181.
Sander et al., "ZiFiT (Zinc Finger Targeter): an updated zinc finger engineering tool," Nucleic Acids Res., 2010, 38:W462-468.
Sander et al., "Zinc Finger Targeter (ZiFiT): an engineered zinc finger/target site design tool," Nucleic Acids Res., 2007, 35:W599-605.
Sander et al., "Targeted gene disruption in somatic zebrafish cells using engineered TALENs," Nat. Biotechnol., 29:697-698 (2011).
Sanjana et al., A transcription activator-like effector toolbox for genome engineering, Nature Protocols, 2012, 7:171-192.
Sapranauskas et al., "The *Streptococcus thermophilus* CRISPR/Cas system provides immunity in *Escherichia coli*," Nucleic Acids Res., 2011, 39(21):9275-9282.
Schleifman et al., "Triplex-mediated gene modification," Methods Mol. Biol., 435:175-190, 2008.
Scholze & Boch, "TAL effectors are remote controls for gene activation," J. Curr. Opin. Microbiol, 14:47-53 (2011).
Schwank et al., "Functional repair of CFTR by CRISPR/Cas9 in intestinal stem cell organoids of cystic fibrosis patients," Cell Stem Cell, Dec. 5, 2013, 13(6):653-8.
Sebo et al., "Cell-invasive activity of epitope-tagged adenylate cyclase of Bordetella pertussis allows in vitro presentation of a foreign epitope to CD8+ cytotoxic T cells," Infect. Immun., Oct. 1995, 63:3851-57.
Segal et al., "Evaluation of a modular strategy for the construction of novel polydactyl zinc finger DNA-binding proteins," Biochemistry, 42(7):2137-2148, Feb. 25, 2003.
Shah et al., "Protospacer recognition motifs," RNA Biol., 2013, 10:891-899.
Sharma, "Schizophrenia, epigenetics and ligand-activated nuclear receptors: a framework for chromatin therapeutics," Schizophr. Res., Jan. 2005, 72:79-90.
Shen et al., "Efficient genome modification by CRISPR-Cas9 nickase with minimal off-target effects," Nat Methods, 2014, 11(4):399-402.
Shen et al., "Generation of gene-modified mice via Cas9/RNA-mediated gene targeting," Cell Res., 2013, 23(5):720-3.
Shmakov et al., "Discovery and Functional Characterization of Diverse Class 2 CRISPR-Cas Systems," Molecular Cell, 2015 60:385-397.
Silva et al., "Meganucleases and other tools for targeted genome engineering: perspectives and challenges for gene therapy," Curr Gene Ther., 11(1):11-27, Feb. 2011.

(56) References Cited

OTHER PUBLICATIONS

Silver, "How Proteins Enter the Nucleus," Cell, 64(3):489-497, Feb. 8, 1991.
Simon et al., "Sequence-specific DNA cleavage mediated by bipyridine polyamide conjugates," Nucl. Acids Res., 36(11):3531-8 (2008).
Stenmark et al., "Peptides fused to the amino-terminal end of diphtheria toxin are translocated to the cytosol," J. Cell Biol., Jun. 1991, 113:1025-32.
Sterman et al., "Adenovirus-mediated herpes simplex virus thymidine kinase/ganciclovir gene therapy in patients with localized malignancy: results of a phase I clinical trial in malignant mesothelioma," Hum. Gene Ther., May 1998, 7:1083-89.
Sternberg et al., "Conformational control of DNA target cleavage by CRISPR-Cas9," Nature, 2015, 527:110-113.
Sternberg et al., "DNA interrogation by the CRISPR RNA-guided endonuclease Cas9," Nature, 2014, 507:62-67.
Sternberg et al., "Mechanism of substrate selection by a highly specific CRISPR endoribonuclease," RNA, 2012, 18:661-672.
Stoddard, "Homing endonuclease structure and function," Q. Rev. Biophys., 38(1): 49-95, Epub Dec. 9, 2005.
Storrs, "A CRISPR Fore-Cas-t: A newcomer's guide to the hottest gene-editing tool on the block," Scientist Magazine, Mar. 2014, 4 pages.
Sugimoto et al., "Thermodynamic parameters to predict stability of RNA/DNA hybrid duplexes," Biochemistry, 1995, 34:11211-11216.
Sugimoto et al., "Thermodynamics-structure relationship of single mismatches in RNA/DNA duplexes," Biochemistry, Sep. 19, 2000, 39(37):11270-81.
Swarts el al., "CRISPR Interference Directed Strand Specific Spacer Acquisition," PLOS, 2012, 7(4):1-7.
Szczepek et al., "Structure-based redesign of the dimerization interface reduces the toxicity of zinc-finger nucleases," Nat Biotechnol., 2007, 25:786-793.
Szyf et al., "DNA methylation and breast cancer," Biochem. Pharmacol., Sep. 2004, 68:1187-97.
Tahiliani et al., "Conversion of 5-Methylcytosine to 5-Hydroxymethylcytosine in Mammalian DNA by MLL Partner TET1," Science, 324:930-935 (2009).
Tan et al., "Efficient nonmeiotic allele introgression in livestock using custom endonucleases," Proc Natl Acad Sci U S A, Oct. 8, 2013, 110(41):16526-31.
Tan et al., "Zinc-finger protein-targeted gene regulation: genomewide single-gene specificity," Proc Natl Acad Sci U S A., 100(21):11997-2002, Epub Sep. 26, 2003.
Terns and Terns, "CRISPR-based adaptive immune systems," Curr Opin Microbiol., 2011, 14:321-327.
Tesson et al., "Knockout rats generated by embryo microinjection of TALENs," Nat. Biotechnol., 29:695-696 (2011).
Tjong and Zhou, "DISPLAR: an accurate method for predicting DNA-binding sites on protein surfaces," Nucleic Acids Res., 35(5):1465-1477, Epub Feb. 6, 2007.
Tsai et al., "Dimeric CRISPR RNA-guided FokI nucleases for highly specific genome editing," Nat Biotechnol., Apr. 2014, 32(6):569-576.
Tsai et al., "GUIDE-Seq enables genome-wide profiling of off-target cleavage by CRISPR-Cas nucleases," Nat Biotechnol, Feb. 2015, 33:187-197.
Tzur et al., "Heritable Custom Genomic Modifications in Caenorhabditis elegans via a CRISPR-Cas9 System," Genetics, 2013, 195:1181-1185.
Uhlmann et al., "Distinct methylation profiles of glioma subtypes," Int. J. Cancer, Aug. 2003, 106:52-9.
U.S. Final Office Action in U.S. Appl. No. 13/838,520, dated Jul. 15, 2015, 35 pages.
U.S. Non-Final Office Action in U.S. Appl. No. 14/211,117, dated Sep. 8, 2015, 20 pages.
U.S. Non-Final Office Action in U.S. Appl. No. 14/213,479, dated Dec. 9, 2015, 39 pages.
U.S. Non-Final Office Action in U.S. Appl. No. 14/213,723, dated Mar. 2, 2016, 39 pages.
U.S. Non-Final Office Action in U.S. Appl. No. 13/838,520, dated Oct. 6, 2014, 38 pages.
Van der Oost et al., "Unravelling the Structural and Mechanistic Basis of Crispr-Cas Systems," Nature Reviews Microbiology, 2014, 12:479-492.
Ventura et al., "Cre-lox-regulated conditional RNA interference from transgenes," PNAS, Jul. 2004, 101:10380-10385.
Waaigers et al., "CRISPR/Cas9-Targeted Mutagenesis in Caenorhabditis elegans," Genetics, 2013, 195:1187-1191.
Wagner et al., "Efficient and persistent gene transfer of AAV-CFTR in maxillary sinus," Lancet, Jun. 1998, 351:1702-1703.
Wang et al., "One-Step Generation of Mice Carrying Mutations in Multiple Genes by CRISPR/Cas-Mediated Genome Engineering," Cell, 2013, 153:910-918.
Wang et al., "Positive and negative regulation of gene expression in eukaryotic cells with an inducible transcriptional regulator," Gene Ther., May 1997, 4:432-441.
Wang et al., "The CRISPR/Cas system mediates efficient genome engineering in Bombyx mori," Cell Res., Dec. 2013, 23(12):1414-6.
Weber et al., "Assembly of Designer TAL Effectors by Golden Gate Cloning," PLoS ONE, 6:e19722 (2011).
Widschwendter and Jones, "DNA methylation and breast carcinogenesis," Oncogene, Aug. 2002, 21:5462-82.
Wiedenheft, "RNA-guided genetic silencing systems in bacteria and archaea," Nature, 2012, 482:331-338.
Wolfe et al., "DNA recognition by Cys2His2 zinc finger proteins," Annu Rev Biophys Biomol Struct. 29:183-212 (2000).
Wong et al., "Detection of aberrant p16 methylation in the plasma and serum of liver cancer patients," Cancer Res., 59(1):71-73 Jan. 1, 1999.
Wood et al., "Targeted Genome Editing Across Species Using ZFNs and TALENs," Science, 333:307 (2011).
Wright et al., "Standardized reagents and protocols for engineering zinc finger nucleases by modular assembly," Nat Protoc., 2006, 1(3):1637-1652.
Wu et al., "Building zinc fingers by selection: toward a therapeutic application," Proc Natl Acad Sci U S A., 92(2):344-348, Jan. 17, 1995.
Wu et al., "Correction of a genetic disease in mouse via use of CRISPR-Cas9," Cell Stem Cell., Dec. 5, 2013, 13(6):659-62.
Wu et al., "Custom-designed zinc finger nucleases: what is next?" Cell Mol Life Sci., 64(22):2933-2944, Nov. 2007.
Wu et al., "Genome-wide binding of the CRISPR endonuclease Cas9 in mammalian cells," Nat Biotechnol. Jul. 2014; 32(7):670-6.
Xu et al., "Optimization of transcriptional regulatory elements for constructing plasmid vectors," Gene. Jul. 2001, 272(1-2):149-56.
Xu et al., "Genome-wide regulation of 5hmC, 5mC, and gene expression by Tet1 hydroxylase in mouse embryonic stem cells," Mol Cell., 42(4):451-464, Epub Apr. 21, 2011.
Yang et al., "One-step generation of mice carrying reporter and conditional alleles by CRISPR/Cas-mediated genome engineering," Cell, Sep. 12, 2013; 154(6):1370-9.
Yang et al., "Optimization of scarless human stem cell genome editing," Nucleic Acids Res., 2013, 41:9049-9061.
Yin et al., "Genome editing with Cas9 in adult mice corrects a disease mutation and phenotype," Nature Biotechnology 32, 551-553 (2014).
Zetsche et al., "Cpf1 is a Single RNA-Guided Endonuclease of a Class 2 CRISPR-Cas System," Cell, 2015, 163:759-771.
Zhang et al., "Efficient construction of sequence-specific TAL effectors for modulating mammalian transcription," Nat Biotechnol., 29(2):149-153, Epub Jan. 19, 2011.
Zhang et al., "TET1 is a DNA-binding protein that modulates DNA methylation and gene transcription via hydroxylation of 5-methylcytosine," Cell Res., 20(12):1390-1393, Epub Nov. 16, 2010.
Zhou et al., "High-throughput screening of a CRISPR/Cas9 library for functional genomics in human cells," Nature. May 22, 2014; 509(7501):487-91.
Zitzewitz et al., "Probing the folding mechanism of a leucine zipper peptide by stopped-flA4:A48ism spectroscopy," Biochemistry, 34(39):12812-12819, Oct. 3, 1995.

(56) References Cited

OTHER PUBLICATIONS

Extended European Search Report in Application No. 14875819.6, dated Jun. 8, 2017, 11 pages.
International Search Report and Written Opinion in International Application No. PCT/US16/49147, dated Dec. 23, 2016, 12 pages.
Jinek et al., "Supplementary Materials for a Programmable Dual-RNA-Guided DNA Endonuclease in Adaptive Bacterial Immunity," Science Express, pp. 1-37 (2012).
Kleinstiver et al., "High-fidelity CRISPR-Cas9 nucleases with no detectable genome-wide off target effects," Nature, Jan. 2016, 529: 490-495.
Office Action in Australian Application No. 2014227653, dated Nov. 18, 2016, 3 pages.
Office Action in European Application No. 14763916.5, dated Mar. 27, 2017, 6 pages.
Office Action in U.S. Appl. No. 14/776,620, dated Mar. 31, 2017, 45 pages.
Office Action in European Application No. 14764159.1, dated Jun. 16, 2017, 4 pages.
Office Action in European Application No. 14764117.9, dated Jul. 6, 2017, 4 pages.
Office Action in European Application No. 14768877.4, dated Jul. 14, 2017, 4 pages.
Office Action in Canadian Application No. 2907198, dated Aug. 24, 2017, 10 pages.
Office Action in U.S. Appl. No. 14/776,620, dated Sep. 28, 2017, 8 pages.
Office Action in European Application No. 14763916.5, dated Oct. 26, 2017, 5 pages.
Office Action in European Application No. 14764159.1, dated Nov. 21, 2017, 3 pages.
Office Action in U.S. Appl. No. 14/775,869, dated Sep. 11, 2017, 43 pages.
Office Action in U.S. Appl. No. 14/211,117, dated Nov. 3, 2017, 11 pages.
Office Action in U.S. Appl. No. 14/211,117, dated Jan. 9, 2017, 12 pages.
Office Action in U.S. Appl. No. 14/211,117, dated Sep. 8, 2015, 20 pages.
European Office Action in Application No. 14768877.4, dated Jan. 8, 2018, 4 pages.
European Office Action in Application No. 14764117.9, dated Jan. 4, 2018, 4 pages.
Farboud and Meyer, "Dramatic Enhancement of Genome Editing by CRISPR/Cas9 Through Improved Guide RNA Design," Genetics, 2015, 199:959-971.
International Preliminary Report on Patentability in International Application No. PCT/US2016/49147, dated Mar. 6, 2018.
Jiang et al., "RNA-guided editing of bacterial genomes using CRISPR-Cas systems," Nature Biotechnology, Mar. 2013, 31: 233-239.
Ma et al., "A Guide RNA Sequence Design Platform for the CRISPR/Cas9 System for Model Organism Genomes," BioMed Research International, 2013, 2013: 270805, 4 pages.
Office Action in Chinese Application No. 201480026133.4, dated Feb. 12, 2018, 22 pages (with English translation).
Office action in Chinese Application No. 201480026276.5, dated Apr. 17, 2018, 12 pages (with English translation).
Office Action in Chinese Application No. 201480027950.1, dated Mar. 23, 2018, 13 pages (with English translation).
Office Action in Japanese Application No. 2016-502976, dated May 8, 2018, 16 pages (with English translation).
Office Action in U.S. Appl. No. 15/107,550, dated Mar. 9, 2018.
BLAST sequence alignment: Query = Applicants SEQ ID No. 26 and Subject = Jinek et al.'s SEQ ID No. 8 from WO2013176772 (Retrieved from the Internet <https://blast.nchi.nlm.nih.gov/Blast.cgi>, retrieved on Feb. 1, 2018, 3 pages.
Sequence Alignment instant SEQ ID No. 1 with SEQ ID No. 103. Search conducted on Feb. 15, 2018, 1 page.
Office Action in Chinese Application No. 201480026276.5, dated Apr. 17, 2018, 16 pages (with English translation).

* cited by examiner

EMX1 truncated gRNA

```
GAAGCTGGAGGAGGAAGGGCCTGAGTCCGAGCAGAAGAAGAAgGGCTCCCATCACATCAACCGGTGG  wild-type x24
GAAGCTGGAGGAGGA                                                      Δ265
                                                      TCAACCGGTGG    Δ181
GAAGCTGGAGGAGGAAGG                                                   Δ138
                                                                     Δ126
                                   GGGCTCCCATCACATCAACCGGTGG          Δ114
GAAGCTGGAGGAGGAAGGGCCTGA                                             Δ101
GAAGCTGGAGGA                                                    GG   Δ53
GAAGCTGGAGGAGGAAGGG             CCCATCACATCAACCGGTGG                 Δ28
GAAGCTGGAGGAGGAAGGGC            TCGCACACATCAACCGGTGG                 Δ27
GAAGCTGGAGGAGGAAGGGC            CTTCCATCACATCAACCGGTGG               Δ25
GAAGCTGGAGGAGGAAGGGCCTGAG       TCCATCACATCAACCGGTGG                 Δ21 x0
GAAGCTGGAGGAGGAAGGGCCTGAGTCCGAG TCCATCACATCAACCGGTGG                 Δ15
GAAGCTGGAGGAGGAAGGGCCTGAGTCCGAGCAGAAG  TCCATCACATCAACCGGTGG          Δ9
GAAGCTGGAGGAGGAAGGGCCTGAGTCCTGCCGTTTGTAG CCATCACATCAACCGGTGG         Δ8
GAAGCTGGAGGAGGAAGGGCCTGAGTCCGAGCAGAAGA   GCTCCCATCACATCAACCGGTGG     Δ6
GAAGCTGGAGGAGGAAGGGCCTGAGTCCGAGCAGAAGAA  CTCCCATCACATCAACCGGTGG      Δ6
GAAGCTGGAGGAGGAAGGGCCTGAGTCCGAGC  AGAAGAAGGGCTCCCATCACATCAACCGGTGG   Δ3 x2
GAAGCTGGAGGAGGAAGGGCCTGAGTCCGAGCAGAAGA  AAGGGCTCCCATCACATCAACCGGTGG  Δ2
GAAGCTGGAGGAGGAAGGGCCTGAGTCCGAGCAGAAGA  AGAAGGGCTCCCATCACATCAACCGGT  +0
```

EMX1 full-length gRNA

```
GAAGCTGGAGGAGGAAGGGCCTGAGTCCGAGCAGAAGAAGAAgGGCTCCCATCACATCAACCGGTGG  wild-type x35
GAAGCTGGAGGAGGAAGGGCCTGAGTCCGAG                                      Δ202
                                                                     Δ115
GAA                                                                  Δ94
                                                                     Δ78
GAAGCTGGAGG                                                          Δ70
GAAGCTGGA                                                     GG     Δ56
GAAGCTGGAGGAGGAAGGGCCTGA                                  GTGG       Δ39
GAAGCTGGAGGAG                GAAGGGCTCCCATCACATCAACCGGTGG            Δ26 x2
GAAGCTGGAGGAGGAAGGGCCTGAGT   CCATCACATCAACCGGTGG                     Δ22
GAAGCTGGAGGAGGAAGGGCCTGAG    TCCATCACATCAACCGGTGG                    Δ21 x3
GAAGCTGGAGGAGGAAGGGCCTGAGTCCGAG  CATCACATCAACCGGTGG                  Δ18
GAAGCTGGAGGAGGAAGGGCCTGAGTCCGA   GCTCCCATCACATCAACCGGTGG             Δ14
GAAGCTGGAGGAGGAAGGGCCTGAGTCCGAGC  AGAAGAAGGGCTCCCATCACATCAACCGGTGG   Δ6 x3
GAAGCTGGAGGAGGAAGGGCCTGAGTCCGAGC  AGAAGAAGGGCTCCCATCACATCAACCGGTGG   Δ3 x3
GAAGCTGGAGGAGGAAGGGCCTGAGTCCGAGCAGA  AAGAAGGGCTCCCATCACATCAACCGGTGG  Δ2 x2
GAAGCTGGAGGAGGAAGGGCCTGAGTCCGAGCAGAAGA  AGAAGGGCTCCCATCACATCAACCGGT  +0
```

FIG. 3C

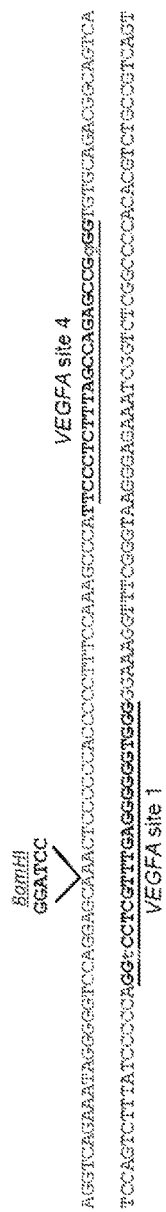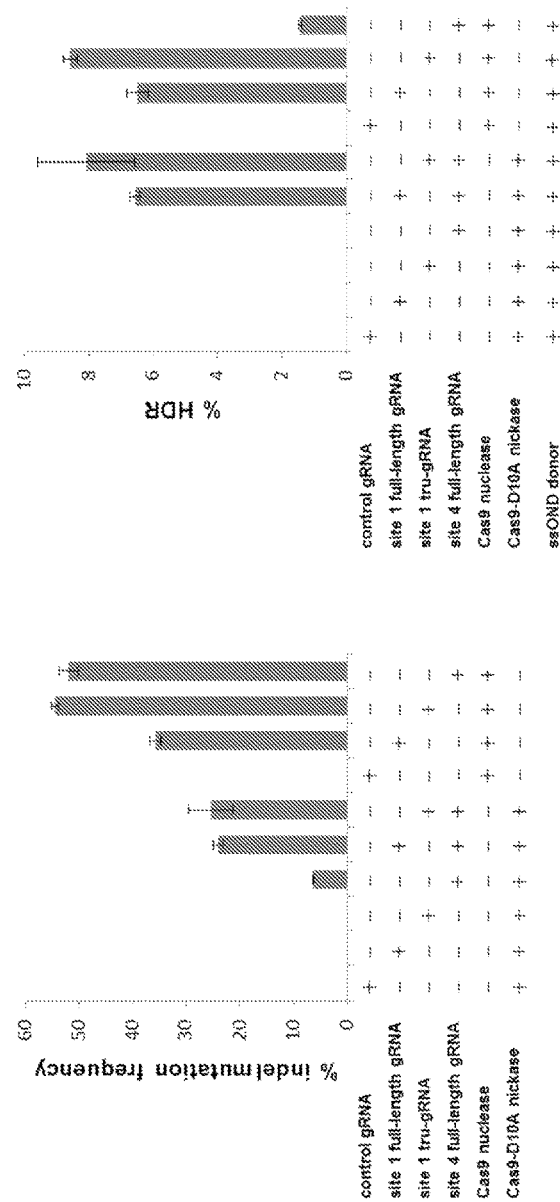
FIG. 4A
FIG. 4B
FIG. 4C

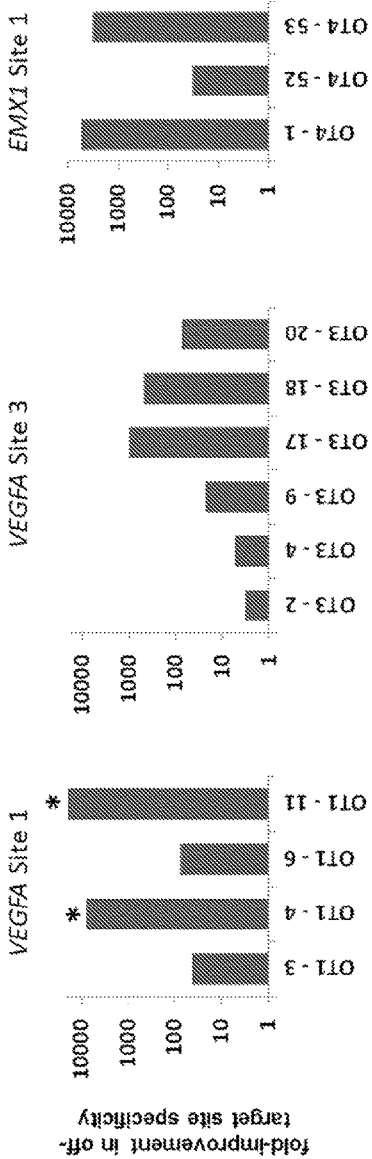

Figure 7A

```
VEGFA site1 full-length gRNA
TAGCTGTTTGGGAGGTCAGAAATAGGGGGTCCaGGAGCAAACTCCCCCCACCCCCTTTCCAAAGCCC  Wild-Type x87
TAGCTGTT---------------------------------------------------------> Δ205
<-----------------------------------------------CCTTTCCAAAGCCC      Δ71
<--------------------------------------------------CCAAAGCCC        Δ67
<-------------------------------------------CCCCACCCCCTTTCCAAAGCCC  Δ55
TAGCTG-----------------------------------------------TTTCCAAAGCCC   Δ49
TAG-----------------------------------------------CCCTTTCCAAAGCCC   Δ49
TAGCTGTTTGGGAGGTCAGA---------------------------------------------   Δ47
TAGCTGTT-----------------------------------------CCCCTTTCCAAAGCCC   Δ43
TAGCTGTTTGGGAGGTCAGAAAT--------------------------------------AGCCC  Δ39
TAGCTGTTTGGGTGG-----------------------------------CCTTTCCAAAGCCC    Δ38
TAGCTGTTTGGGAGGTCAGAAATAGG---------------------------------CAAAGCCC Δ33
TAGCTGTTTGGGAGGT--------------------------------CACCCCCTTTCCAAAGCCC Δ32
TAGCTGTTTCTGA------------------------------CCTCCCACCCCCTTTCCNAAGCCC Δ30
TAGCTGTTTGGGAGGTCAGAAATAGGGGGTCCAG--------------------------ANCCC   Δ28
TAGCTGTTTGGGAGGTCAGAAAT-------------------------ACCCCCTTTCCAAAGCCC  Δ26
TAGCTGTTTGGGAGGTCAGAAATAGGGGGT--------------------CCCTTTCCAAAGCCC   Δ22
TAGCTGTTTGGGAGGTCAG-----------------AAACTCCCCCACCCCCTTTCCAAAGCCC    Δ19 x2
TAGCTGTTTGGGAGGTCAGAAATAGGGGGT-----------------CCACCCCCTTTCCAAAGCCC Δ17
TAGCTGTTTGGGAGGTCAGAAATAGGGGGT----------------CCCACCCCCTTTCCAAAGCCC Δ16
TAGCTGTTTGGGAGGTCAGAAATAGGG---------------TCCCCCCNCCCCCTTTCCNAANCCC Δ15
TAGCTGTTTGGGAGGTCAGA---------------AGCAAACTCCCCCACCCCCTTTCCAAAGCCC  Δ15
TAGCTGTTTGGGAGGTCAGAAAT---------------AAACTCCCCCACCCCCTTTCCAAAGCCC  Δ15
NAGCTGNTTGGGAGGNCNNA---------------NNGCAAACTCCCCCCACCCCCTTTCCAAANCCC Δ14
TAGCTGTTTGGGAGGTCAGAAATAGGGGGT---------------CCCCCACCCCCTTTCCAAAGCCC Δ14
TAGCTGTTTGGGAGGTCAGAAATAGGGGGTCCA-------------CCCACCCCCTTTCCAAAGCCC Δ13
TAGCTGTTTGGGAGGTCAGAAAT--------------AGCAAACTCCCCCACCCCCTTTCCAAAGCCC Δ12
TAGCTGTTTGGGAGGTCAGAAATAGGGGGTCCAGGA----------CCCCACCCCCTTTCCAAAGCCC Δ9
TAGCTGTTTGGGAGGTCAGAAATAGGGGGTCC--------AACTCCCCCACCCCCTTTCCAAAGCCC Δ7
TAGCTGTTTGGGAGGTCAGAAATAGGGGGTC-------CACCCCCTTTCCACCCCCTTTCCAAAGCCC Δ6
TAGCTGTTTGGGAGGTCAGAAATAGGGGGTCCAGG-----ACTCCCCCACCCCCTTTCCAAAGCCC  Δ5 x2
TAGCTGTTTGGGAGGTCAGAAATAGGGGGTCCAGG----AACTCCCCCACCCCCTTTCCAAAGCCC  Δ4 X2
TAGCTGTTTGGGAGGTCAGAAATAGGGGGTCC----AGCAAACTCCCCCACCCCCTTTCCAAAGCCC Δ3
TAGCTGTTTGGGAGGTCAGAAATAGGGGGTCCAG--GCAAACTCCCCCACCCCCTTTCCAAAGCCC  Δ2 X3

TAGCTGTTTGGGAGGTCAGAAATAGGGGGTCCAGGAGTGCTAGATCTTCATCTAAAGACATTTCTGA +191
GAAAAATGTATCTGTTTTCTTTCAGAAGAAATTTACACTTAATAGATATTATGGTAACTAAAGTAAG
GCAGATAATTTTGGCCATCAGCTTATATTGTGGGATAATCTCTTTTTGCTGACCTTGAAAAGNTGTG
GCATATTCACAACAAGTAGGAAAATTGCAAACTCCCCCACCCCCTTTCCAAAGCCC
```

Figure 7B

```
VEGFA site1 truncated gRNA
TGGGAGGTCAGAAATAGGGGGTCCaGGAGCAAACTCCCCCACCCCCTTTCCAAAGCCCATTCCCTC  Wild-
Type x85
TGGGAGGTCAGAAATAGGGGGTCCAGGA------------------------------------>  Δ144
<------------------------------------CACCCTCTTTCCAAAGCCCATTCCCTC  Δ112
<-----------------------------CAAACTCCCCCCACCCCCTTTCCAAAGCCCATTCCCTC  Δ111
<----------------------------------------------------AAGCCCATTCCCTC  Δ80
<------------------------------------------------------------TCCCTC  Δ80
<--------------------------------------------------TTCCAAAGCCCATTCCCTC  Δ61
TGGGAGGTC------------------------------------------------------>  Δ61
<-----------------------------------CCCACCCCCTTTCCAAAGCCCATTCCCTC  Δ56
<-----------------------------------CCCACCCCCTTTCCAAAGCCCATTCCCTC  Δ44
TGGG--------------------------------CCCCTTTCCAAAGCCCATTCCCTC  Δ39
TGGGAG------------------------------CCCCTTTCCAAAGCCCATTCCCTC  Δ36
TGGGAGGTCAGAAA----------------------CACCCCCTTTCCAAAGCCCATTCCCTC  Δ26
TGGGAGGTCAGAAATAGGGGGT---------------CCCCCTTTCCAAAGCCCATTCCCTC  Δ20
TGGGAGGTCAGAA--------------AAACTCCCCCACCCCCTTTCCNAAGCCCATTCCCTC  Δ17
TGGGAGGTCAGAAATAGGGGGT---------------CCACCCCCTTTCCAAAGCCCATTCCCTC  Δ17
TGGGAGGTCAGAAATAGGGGGT--------------CCCACCCCCTTTCCAAAGCCCATTCCCTC  Δ16
TGGGAGGTCAGAAATAGG---------------TCCCCCCACCCCCTTTCCAAAGCCCATTCCCTC  Δ16
TGNGAGGTCAGA---------------AGCAAACTCCCCCCACCCCCTTTCCAAAGCCCATTCCCTC  Δ15
TGGGAGGTCAGAAATAGGGGGT---------------CCCCCACCCCCTTTCCAAAGCCCATTCCCTC  Δ15
TGGGAGGTCAGAAATAGGGGG---------------TCCCCCACCCCCTTTCCAAAGCCCATTCCCTC  Δ13 x2
TGGGAGGTCAGAAATAGGGGGTCCAGGA---------CACCCCCTTTCCAAAGCCCATTCCCTC  Δ12
TGGGAGGTCAGAAATAG------------GCAAACTCCCCCCACCCCCTTTCCAAAGCCCATTCCCTC  Δ11 x2
TGGGAGGTCAGAAATAGGGGGTCCAGGA---------CCCCACCCCCTTTCCAAAGCCCATTCCCTC  Δ9
TGGGAGGTCAGAAATAGGGGGTCCAGG---------NCCCCCACCCCCTTTCCAAAGCCCATTCCCTC  Δ8
TGGGAGGTCAGAAATAGGGGGTCCAG---------CTGGCCCCACCCCCTTTCCAAAGCCCATTCCCTC  Δ7
TGGGAGGTCAGAAATAGGGGGTC--------CAAACTCCCCCCACCCCCTTTCCAAAGCCCATTCCCTC  Δ6 x5
TGGGAGGTCANAAATAGGGGGTCCAG-------ACTCCCCCCACCCCCTTTCCAAAGCCCATTCCCTC  Δ6
TGGGAGGTCAGAAATAGGGGGTCCAGG-----ACTCCCCCCACCCCCTTTCCAAAGCCCATTCCCTC  Δ5
TGGGAGGTCAGAAATAGGGGGTCC----AGCAAACTCCCCCCACCCCCTTTNNNNNNCCCATTNNNTC  Δ3
TGNGAGGTCAGAAATAGGGGGTCCAGGA--AAACTCCCCCCACCCCCTTTCCAAAGCCCATTCCCTC  Δ2

TGGGAGGTCA-------------------CCCCCTTTCCAAAGCCCACCCCCTTTCCAAAGCC  Δ9 (+14
Δ23)
TGGGAGGTCAGAAATAGGGGGTCCAGGAAAGCAAACTCCCCCCACCCCCTTTCCAAAGCCCATTCCC  +2
```

Figure 7C

```
VEGFA site3 full-length gRNA
GAGGACGTGTGTGTCTGTGTGGGTGAGTGAGTGTGTGCGTGtGGGGTTGAGGGTGTTGGAGCGGGGA Wild-
type x35
GAGGACGTGTGTGTCTGTGTG------------------------------------------->  Δ117
GAGGACGTGTGTGTTGG---------------------------------------------->  Δ84
GAGGACGTGTGTGTCTGTGTG------------------------------------------->  Δ75
GAGGACGTGTGTGTCTGTGTG------------------------------------------->  Δ49
GAGGACGTGTGTGTCTGTGTGGGTGAGTGAGTGTGTG--------------------------->  Δ43
GAGGACGTGTGTGTCTGTGTGGGTGAGTG----------------------------------->  Δ40
GAGGACGTGTGTGTCTGTGTGAGT------------------------------------GGGA Δ39
GAGGACGTGTGTGTCTGTGTGGGTGAGTGAGTGTNNG--------------------------->  Δ37
GAGGACGTGTGTGTCTGTGTGGGTGAGT-----------------------------GAGNGNGGGN Δ30 x2
GAGGACGTGTGTGTCTGTGTGGGTGAGTGAG-------------------------TGGGGCGGGGA Δ25
GAGGACGTGTGTGTCTGTGTGGGTGAGTGAGTG------------------------TGGAGCGGGGA Δ23
GAGGACGTGTGTGTCTGTGTGGGTGAGTGAGT-------------------------GTTGGAGCGGGGA Δ22
GAGGACGTGTGTGTCTGTGTGGGTGAGTGAGTGT------------------------GTTGGAGCGGGGA Δ20
GAGGACGTGTGTGTCTGTGTGGGTGAG------------------------TGAGGGTGTTGGAGCGGGGA Δ20 x2
GAGGACGTGTGTGTCTGTGTGGGTGAGTGAGT-------------------GGGCGTTGGAGCGGGGA Δ18
GAGGACGTGTGTGTCTGTGTGGGTGA-------------NNGTGGGGTTGAGGGTGTTGGAGCGGGGA Δ12
GAGGACGTGTGTGTCTGTGTGGGTGAGTGA--------GTGTGGGGTTGAGGGCGTTGGAGCGGGGA Δ8 x3
GAGGACGTGTGTGTCTGTGTGGGTGAGTGAGTGTGT-------GGGTTGAGGGCGTTGGAGCGGGGA Δ7
GAGGACGTGTGTGTCTGTGTGG-TGAGTGAGTGTGT------GGGGTTGAGGGTGTTGGAGCGGGGA Δ6
GAGGACGTGTGTGTCTGTGTGGGTGAGTGAGT------GNGTGGGGTTGAGGGTGTTGGAGCGGGGA Δ6 x5
GAGGACGTGTGTGTCTGTGTGGGTGAGTGAGTGT-----GTGTGGGGTTGAGGGTGTTGGAGCGGGGA Δ4
GAGGACGTGTGTGTCTGTGTGGGTGAGTGAGTGTGTGC----TGGGGTTGAGGGTGTTGGAGCGGGGA Δ3

GAGGANGNGTGTGTCTGTGTGGGTGAGTGAGTGTGTGTGGGTGAGTGAGTGTGTGTCTGTGGGGTTG +20
GAGGACGTGTGTGTCTGTGTGGGTGAGTGAGTGTGTGCGTCGTGTGGGGTTGAGGGTGTTGGAGCGG +3
GAGGACGTGTGTGTCTGTGTGGGTGAGTGAGTGTGTGCAAAGTGTGGGGTTGAGGGTGTTGGAGCGG +3
GAGGACGTGTGTGTCTGTGTGGGTGAGTGAGTGTGTGCGTGTGCGGGGTTGAGGGTGTTGGAGCGGG +2
```

Figure 7D

```
VEGFA site3 truncated gRNA
TGAGGACGTGTGTGTCTGTGTGGGTGAGTGAGTGTGTGCGTGtGGGGTTGAGGGTGTTGGAGCGGGG  Wild-
                                                                    type x47
GGGAGGTCAGAAATAGGGGGT---------------------------------------------> Δ324
<-----------------------------------------------------------------> Δ201
TGAGGACGTGTGTGTCTGTGTGGGTGAGTGAGTGTGTG----------------------------> Δ157
TGAGGACGTGTGTGT---------------------------------------------------> Δ153
TGAGGACGTGTGTGTCTGTGTGGGAGANNGANNGNGNG----------------------------> Δ88
TGAGGACGTGTGTG----------------------------------------------------> Δ87
TGAGGACGTGTGTGTCTGTGTGG-------------------------------------------> Δ83
TGAGGACGTGTGTGT------------------------------------------------GG  Δ50
TGAGGACGTGTGTGTCTGTGTGGGTGAGTG------------------------------------> Δ40
TGAGGACGTGTGTGTCTGTGTGGGTGA------------------------------------GG  Δ38
TGAGGACGTGTGTGTCTGTGTGGGTGAGT-----------------------------------G  Δ37
TGAGGACGTGTGTGTCTGTGTGGGTGAGTGA--------------------------GGAGCGGGG Δ27
TGAGGACGTGTGTGTCTGTGTGGGTGAGTGA--------------------------GTTGGAGCGGGG Δ24
TGAGGACGTGTGTGTCTGTGTGGGTGAGT----------------------------GTGTTGGAGCGGGG Δ24
TGAGGACGTGTGTGTCT--------------------GTGTGGGGTTGAGGGCGTTGGAGCGGGG Δ22
TGAGGACGTGTGTGTCTGTGTGGGTGAGTGAGT------------------------GTTGGAGCGGGG Δ22
TGAGGACGTGTGTGTCTGTGTGGGTGAGTGAGTGT----------------------GTTGGAGCGGGG Δ20 X2
TGAGGACGTGTGTGTCTGTGTGGGTGAG---------------------TGAGGGCGTTGGAGCGGGG Δ20 X2
TGAGGACGTGTGTGTCTGTGTGGGTGAGTGA----------------GTTGAGGGTGTTGGAGCGGGG Δ15
TGAGGACGTGTGTGTCTGTGTGGGTGAGTGAGT---------------GTTGAGGGCGTTGGAGCGGGG Δ13
TGAGGACGTGTGTGTCTGTGTGGGTGAGTGT-----------------GTTGAGGGCGTTGGAGCGGGG Δ11
TGAGGACGTGTGTGTCTGTGTGGGTGAGT----------NNNGGGGGGNNGANGGNGTTGNNNNNGGG Δ9
TGAGGACGTGTGTGTCTGTGTGGGTGAGTGA---------NNNGGGGNTGAGGGTGTTGGAGCGGGG Δ9
TGAGGACGTGTGTGTCTGTGTGGGTGAGTGA---------GTGTGGGGTTGAGGGGNTGNNNNNNGGG Δ8 X3
TGAGGACGTGTGTGTCTGTGTGGGTGAGTGAGTGTGT-------GGGTTGAGGGCGTTGGAGCGGGG Δ7
TGAGGACGTGTGTGTCTGTGTGGGTGAGTGAGT-------GTGTGGGGTTGAGGGTGTTGGAGCGGGG Δ6 X5
TGAGGACGTGTGTGTCTGTGTGGGTGAGTGAGTGTGTGNGGNTGNGGTTGA------NGGAGNNGGA Δ6
TGAGGACGTGTGTGTCTGTGTGGGTGAGTGAGTGT-----GTGTGGGGTTGAGGGTGTTGGAGCGGGG Δ4
TGAGGACGTGTGTGTCTGTGTGGGTGAGTGAGTG-----CGTGTGGGGTTGAGGGTGTTGGAGCGGGG Δ4
TGAGGACGTGTGTGTCTGTGTGGGTGAGTGAGTGAGT---GTGTGGGGTTGAGGGCGTTGGAGCGGGG Δ2

TGAGGACGTGTGTGTCTGTGTGGGTGAGTGAGTGAGTGAGTGNGTGGGGTTGAGGGCGTTGGAGCGG +2

TGAGGACGTGTGTGTCTGTGTGGGTGAGTGAGTGTGTGCTCGTGTGGGGTTGAGGGCGTTGGAGCGG +2

GGGTGAATGGAGCGAGCAGCGTCTTCGNGNGNGAGGACGTGNNNGTCTGNGTGNGTNNGNGAGTGTG +234 x2
TGCTAGGGTTAGGGTTAGGGTTAGGGTTAGGGTTAGGGTTAGGGTTAGGGTTAGGGTTAGGGTTAGG
GTTAGGGTTAGGGTTAGGGTTAGGGTTAGGGTTAGGGTTAGGGTTAGGGTTAGGGTTAGGGTNANNN
TTAGGGTTNNNNNNAGGNNNANNGTTANGGTTAGGGTTAGGGTTAGGGTTAGGGNTAGGGTTAGGGT
TAGGGTTAGGGTTAGGGTTAGGGTTAGGGTTAGGGTGTGTGGGGTTGAGGGCGTTGGAGCGG
```

Fig. 8A

Target 1 (*VEGFA* Site 1):

OT1-3
AGACAGGACATTCTGACACCCCAGGAGCAAACTCCCTCCATCCCACAAATCCGTCCTTAGATGTGCA Wild-type x18
――――――――――――――――――――――AACTCCCTCCATCCCACAAATCCGTCCTTAGATGTGCA Δ53
AGACAGGACATTCTGACACC――――――――――CCATCCCACAAATCCGTCCTTAGATGTGCA Δ17
AGACAGGACATTCTGACACCCCAGGA――――――――CCCACAAATCCGTCCTTAGATGTGCA Δ15
AGACAGGACATTCTGACACCCCAG――GCAAACTCCCTCCATCCCACAAATCCGTCCTTAGATGTGCA Δ2

AGACAGGACATTCTGACACCCCAGGAGGGCAAACTCCCTCCATCCCACAAATCCGTCCTTAGATGTGCA +2

OT1-6
GAGAGAGGCTCCCATCACGGGGGAGGGAGTTTGCTCCTGGGGAACCTGTGATCCCCACAGGGAACA Wild-type x87
GAGAGAGGCTCCCATCACGGGGG―――――――――――――――――――AGGGAACA Δ35 x3
GAGAGAGGCTCCCATCACGGGGGA――――――――GGGGAACCTGTGATCCCCACAGGGAACA Δ14 x1

OT1-11
TGGACTCTACCCACTGAATGCCAGGAGCAAACTTCCCCTCCCCGAGTTGTGACAGCAAAAATGTCTC Wild-type x27
TGGACTCTACCCACTG―――――――――――――――――――――――AATGTCTC Δ43
TGGACTCTA――――――――CCCCTCCCCGAGTTGTGACAGCAAAAATGTCTC Δ25
TGGACTCTAC―――――――――CCCCTCCCCGAGTTGTGACAGCAAAAATGTCTC Δ24
TGGACTCTACCCACTGAATG――――――――CCCTCCCCGAGTTGTGACAGCAAAAATGTCTC Δ15
TGGACTCTACCCACTGAATG――――――――CCCTCCCCGAGTTGTGACAGCAAAAATGTCTC Δ15
TGGACTCTACCCACTGAAT―――――GCAAACTTCCCCTCCCCGAGTTGTGACAGCAAAAATGTCTC Δ7
TGGACTCTACCCACTGAATGCCAGGA―――――TTCCCCTCCCCGAGTTGTGACAGCAAAAATGTCTC Δ6
TGGACTCTACCCACTGAATGCCTGG―――――CATCCCCTCCCCGAGTTGTGACAGCAAAAATGTCTC Δ6
TGGACTCTACCCACTGAATGCCAGG――AAACTTCCCCTCCCCGAGTTGTGACAGCAAAAATGTCTC Δ3

TGGACTCTACCCACTGAATGCCAGGA*TGGAAGATAATTTTTTCCATAGACCAGGGTGGGGGAATGGTTTCGGGAT
GATTCAAGCACATCACATTTATTGTGCACTTTATTTCTATTACTATTATATTGTAATGTATACTAAAAATAATTA
TACAACTCACCATAATGTAGAACCAGTGGGAGCC*GCAAACTTCCCCTCCCCGAGTTGTGACAGCAAAAATGTCTC
A +158

TGGACTCTACCCACTGAATGCCAGGCAAACTTCCCCTCCCCGAGTTGTGACA*GCAAAAATGTCTGGCCTAATGTC
TG*GCAAAAATGTCTCAAGACATTGCCAAATGTCCCCT +23 (Δ2 +25)

Fig. 8B
Target 2 (*VEGFA* Site 2):

OT2-2
```
ACCCACCTCCCTATCCTCAAAACTTGGCCAGAGGCGGGGTGGAGGGGCCCCTAGGAGCGCCTTGGTG  Wild-
type   x30
ACCCAC------------------------------------------------CGCCTTGGTG  Δ51
ACCCACCTCC----------------------------------TATCCTAGGAGCGCCTTGGTG  Δ36
ACCCACCTCCCTATCCTCAAAACTT--------------------------CCCTTGGTG  Δ33
ACCCACCTCCCTATCCTCAAAACTTGGCCAGAG-----------------TAGGAGCGCCTTGGTG  Δ18
ACCCACCTCCCTATCCTCAAAACTT----------GGGGTGGAGGGGCCCCTAGGAGCGCCTTGGTG  Δ10
ACCCACCTCCCTATCCTCAAAACTT-------GGCGGGTTGGAGGGGCCCCTAGGAGCGCCTTGGTG  Δ7
ACCCACCTCCCTATCCTCAAAACTTGGCCAGA------GTGGAGGGGCCCCTAGGAGCGCCTTGGTG  Δ6
ACCCACCTCCCTATCCTCAAAACT------------------------------------------
CTGGCAGTCTGTCAGTGCGTTATCTTGTCACACTTCTACAAGGGGGCTCTCCCTGCATTCTGA  +21 (Δ40,
+61)
ACCCACCTCCCTATCCTCAAAACTTGGCCAGAGGGCGCCTCCCCAGGAAGTGCTCCGGCCAGCCCAGGGTAAACA
CGCTAGCCCTGCCCCTCTGGGACCATAGCCCGGGGACCCAGACTCTTGGCCACGCTCATTCCCACCGCGGGGTGG
AGGGGCCCCTAGGAGCGCCTTGGTG +108
```

OT2-15
```
TGACTGTCGGTGCCCCACATGTGGCAGATGCCCAGAGGCGGGGTGTGGGGGGTACTTTGTGGGCGTT  Wild-
type X71
TGACTGTC-------------------------------GGTGTGGGGGGTACTTTGTGGGCGTT  Δ33
TGACTGTCGGTGCCCCACATGTGGCAGATGCCCAGAG---------------------GGGCGTT  Δ23
TGACTGTCGGTGCCCCACATGTGGCAGA-----------------TGTGGGGGGTACTTTGTGGGCGTT  Δ15
TGACTGTCGGTGCCCCACATGT--------------GGCGGGGTGTGGGGGGTACTTTGTGGGCGTT  Δ14
TGACTGTCGGTGCCCCACATGTGGCAGATG----GAGGCGGGGTGTGGGGGGTACTTTGTGGGCGTT  Δ4
TGACTGTCGGTGCCCCACATGTGGCAGATGCCCAGA-----GGGTGTGGGGGGTACTTTGTGGGCGTT  Δ4
TGACTGTCGGTGCCCCACATGTGGCAGATGCCCAGAG--GGGGTGTGGGGGGTACTTTGTGGGCGTT  Δ2
TGACTGTCGGTGCCCCACATGTGGCAGATGCCCAGAGTTGCGGGGTGTGGGGGGTACTTTGTGGGCGTT  +2
TGACTGTCGGTGCCCCACATGTGGCAGATGCCCAGAGCTGCGCGGGGTGTGGGGGGTACTTTGTGGGCGTT  +2
```

OT2-24
```
ACAAGATGACTATGTCCCTCTGGGCCCCATCCTCCCCTCCCCACCCACCCCGCCTCAGGCTTGAAGA  Wild-
type x8
ACAAGA----------------------------------------------------------  Δ121
------------------------------------------------CTCAGGCTTGAAGA  Δ82
ACAAGATG--------------------------------------------------------  Δ80
----------------------------------------------------------------  Δ79
ACAAGATGACTATGTCCCTCTGGGCCCCATCCTCC-----------------------------  Δ42
ACAAGATGACTATGTCCCTCTGGGC-------------------------------CTTGAAGA  Δ34
ACAAGATGACTATGTCCCTCTGGGCCCCATCCTCCCCTCCC-----------CAGGCTTGAAGA  Δ14
ACAAGATGACTATGTCCCTCTGGGCCCCATCCTCCCCTCC------------CCTCAGGCTTGAAGA  Δ12
ACAAGATGACTATGTCCCTCTGGGCCCCATCCTCCCCTCCCCA---------GCAGGCTTGAAGA  Δ11
ACAAGATGACTATGTCCCTCTGGGCCCCATCCTCCCCTCCCCACCCAC----CTTGAAGA  Δ11
ACAAGATGACTATGTCCCTCTGGGCCCCATCCTCCCCTCCC----------GCTCAGGCTTGAAGA  Δ11

ACAAGATGACTATGTCCCTCTGGGCCCGCCTCAAGTGATCCAGCTGCCTTGGCCTCCAAAAGTGCTAGCAGTACA
GATGTGAGCCTCCATGCCTGGCCTATTGCAACATCCCATCTCTGTGAAGCAGGGTTTTCTGCAGTGACAGCAAGA
AGAGCACAGGGCCAAAAAAACTTTGTCCTTTAGAAAGGATCTACCTTTTAGGCTGAGAATGGCA +76 (Δ43
+119)
```

Fig. 8C

Target 3 (*VEGFA* Site 3):

OT3-2
```
GAGTGAGAGAGCGAGTGAGTGAGTGAGTGAGTGAGTGTGTGTGTGGGGGGGACTCGGCTTGTTGTTGTCGG Wild-
type x14
GAGTGAGAGAGCGAGTGAGTGAGTGAGTGA-----GTGTGTGGGGGGGACTCGGCTTGTTGTTGTCGG Δ4
GAGTGAGAGAGCGAGTGAGTGAGTGAGTGA-------GTGTGGGGGGGACTCGGCTTGTTGTTGTCGG Δ6 x2
```

OT3-9
```
GTGTTGGGATGCGGGAGTGGGTGAGTGAGTGCGTGCGGGTGGCGATGCAAGCGTGTGCGAATGCGTG x173
GTGTTGGGATGCGGGA--------------------------------------------> Δ80
GTGTTGGGATGC-------------------------------------------------GCGTG Δ50
GTGTTGGGATGCGGGAGTGGGTGAGTGA--------GTGGCGATGCAAGCGTGTGCGAATGCGTG Δ10

GTGTTGGGATGCGGGAGTGGGTGAGTGAGTGCAAGTGCGGGTGGCGATGCAAGCGTGTGCGAATGCGTG +2
```

OT3-18
```
TTTCAAAGACAGTAGATCTTAAATGTCCTCACGCACACACTCACCCACACATAAAAGGTGGTAACTG Wild-
type x27
TTTCAAAGACAGTAGATCT-------------------------------TAAAAGGTGGTAACTG Δ32
TTTCAAAGACAGTAGATCTTAAATGT-----------------------CATAAAAGGTGGTAACTG Δ23
TTTCAAAGACAGTAGATCTTAAATGTCCT-------------------CACATAAAAGGTGGTAACTG Δ18 x4
TTTCAAAGACAGTAGATCTTAAATGTCCT-----------------CCACACATAAAAGGTGGTAACTG Δ15
TTTCAAAGACAGTAGATCTTAAATGTC-------------CTCACCCACACATAAAAGGTGGTAACTG Δ12
TTTCAAAGACAGTAGATCTTAAATGTCCTCA--CACACACTCACCCACACATAAAAGGTGGTAACTG Δ2

TTTCAAAGACAGTAGATCTTAAATGTCCTCACAGGCTGGAGTACAGTGGCATGATATCAGCTCACTGCAATCTCG
GGCTCCCGGGTTCAAGCCATGCACACACTCACCCACACATAAAAGGTGGTAAC +63
```

Target 4 (*EMX1*):

OT4-1
```
ACCTGTACATCTGCACAAGATTGCCTTTACTCCATGCCTTTCTTCTTCTGCTCTAACTCTGACAATC Wild-
type x20
---------------------------------------------------------------ATC Δ64
ACCTGTACATCTGCACAAGATTGCCTTTACTCC---------------------------ACAATC Δ28
ACCTGTACATCTGCACAAGATTGCCTTTACTCCAT-----------------------ACTCTGACAATC Δ20
ACCTGTACATCTGCACAAGATTGC------------------CTTCTGCTCTAACTCTGACAATC Δ20
ACCTGTACATCTGCACAAGATTGCCTTTACTCCATGCCTTTCT-----------------CAATC Δ19
ACCTGTACATCTGCACAAGATTGCCTTTACTCCA-------------TGCTCTAACTCTGACAATC Δ14
TCCTGTACATCTGCACAAGATTGCCTTTACTCC--------CTTCTTCTGCTCTAACTCTGACAATC Δ8
```

Fig. 9A

Target 1 (*VEGFA* Site 1):

OT1-3
```
TCAGACAGGACATTCTGACACCCCAGGAGCAAACTCCCTCCATCCCACAAATCCGTCCTTAGATGTG Wild-type x41
TCAGACAGGACATT              CAAACTCCCTCCATCCCACAAATCCGTCCTTAGATGTG Δ15
TCAGACAGGACATTCT----------GAGCAAACTCCCTCCATCCCACAAATCCGTCCTTAGATGTG Δ10
TCAGACAGGACATTCTGAC-------GCAAACTCCCTCCATCCCACAAATCCGTCCTTAGATGTG Δ9
TCAGACAGGACATCCTGACAC------GCAAACTCCCTCCATCCCACAAATCCGTCCTTAGATGTG Δ7
TCAGACAGGACATTCTGACACCCAG--GCAAACTCCCTCCATCCCACAAATCCGTCCTTAGATGTG Δ2 x6

TCAGACAGGACATTCTGACACCCCAGGATGTCCTCCTCCCTCCATCCCACAAATCCGTCCTTAGATGTG +2

TCAGNCAGGACATTNNGNCACCCCAGGAAAACNNGAGTTTTCGNTNCNNNGANNGTCAGACCCAGNAGCAAACTCCCTCCATC
CCACAAATCCGTCCTTAGATGTG +38

TCAGACAGGACATTNTGACACCCCAGGAGTNTGCACNTCAGTTTTCTTTANTATGTNGNNNNGGGGCANGNACAAANNTTTN
GCAAACTCCCTCCATCCCACAAATCCGTCCTTAGATGTG +54

TCAGACAGGACATTCTGACACCCCAGGATGTTTGTTTGAGTCAGAGTCTCTCTTTTGTCACCCAGGCTGGAGTGCAGTGGAA
ACCTGTGCCTTTTGTATATCCTCTTTGAAGGTTAAAGAGTCATCATGGATCANCNNCATAAAGCAAACTCCNTCCATCC
+116

TCAGACAGGACATTCTGACACCCCAGGATAAGCGGCAGGGTCGGAACAGGAGAGCGCACGAGGGAGCTTCCAGGGGGAAACG
CCTGGTATCTTTATAGTCCTGTCGGGTTTCGCCACCTCTAGGGGAGTTCTGAGCTCTGACGCCGGGCGTGTTAGGAGATAGC
AGGCCGTTAATGACCATCCCAGCCGAATTCCTCACTGTGCAGATGAGGAAGTGAGCTCAGGGAGGCTGAGTGTCCCAGGCCT
GTTGCCAGATGAGGCCACGCTGAGACTGTGCAAACTCCCTCCATCCCACAAATCCGTCCTTAGATGTG +247
```

OT1-6
```
TGGAGAGAGGCTCCCATCACGGGGGAGGGAGTTTGCTCCTGGGGAACCTGTGATCCCCACAGGGAAC Wild-type x88
TGGAGAGAGGCTCCCATCACGGGGGAGGGAGTTTG---------CCTGTGATCCCCACAGGGAAC Δ11
TGGAGAGAGGCTCCCATCACGGGGGAGGGAGTTT-------GGGAACCTGTGATCCCCACAGGGAAC Δ7
```

OT1-11
```
AGCATCGCTGGACTCTACCCACTGAATGCCAGGAGCAAACTTCCCCTCCCCGAGTTGTGACAGCAAA Wild-type x84
AGCATCGCTGGACTCTACCCACTGAATGCCAGGA-------------CCCGAGTTGTGACAGCAAA Δ14
AGCATCGCTGGACTCTACCCACTGA--------GCAAACTTCCCCTCCCCGAGTTGTGACAGCAAA Δ9
AGCATCGCTGGACTCTACCCACTGAATGCCAG--GCAAACTTCCCCTCCCCGAGTTGTGACAGCAAA Δ2

AGCATCGCTGGACTCTACCCACTGAATGCCAGGAGTTCAGACGATTGAATGTATCAACTTGGCACATTGCCTATCAACTGGT
GAGTGCTCAAAAATATCCATTGCTGTGATCAGTAATGCCACAGGGTGACCATTTAAGGACAGAGTCCATGTTTTATCCATCC
TTAGCAAACTTCCCCTCCCCGAGTTGTGACAGCAAA +133

AGCATCGCTGGACTCTACCCACTGAATGCCAGAGCCCTTCCTTCTCCCTCTCTTCCTCCAGAGGTCCTGCCGAGATCAGGTT
GGAGGTCCTCTTTGTTCTTATGCCCATTCCTCCCCCAGGCACTTGGAGGAGGGCACTGTTTTTGAGTGTGCAAGTCTTTCTC
TGTTACTGTTGGGCAAACTTCCCCTCCCCGAGTTGTGACAGCAAA +142

AGCATCGCTGGACTCTACCCACTGAATGCCAGGATGTTTTGTTTGCGACGGANTCTCACTCTGTCGNCCGGGCTGGAGTGCA
NNGGCACANTTCCTCANCTGACTGCNATGTCCGCCTCCCGGATTCAAGTGATTCTCCTGCCCCAGCCTCCCGAGTAGCTGGG
ATTATAGGTGCCTGCCACCATGCCTGGCTAATTTTTTTTTTTTTTTAAATGGAGTCTCACTCTGTTGCCCCCGAGTTGTGA
CAGCAAA +186
```

Fig. 9B

Target 2 (*VEGFA* Site 2):

OT2-2
```
CACCTCCCTATCCTCAAAACTTGGCCAGAGGCGGGGTGGAGGGGCCCCTAGGAGCGCCTTGGTGGGA
CACCTCCCTATCCTCAAAACTTGGCCAGAGGCGGGGT-------------GGAGCGCCTTGGTGGGA  Δ13
CACCTCCCTATCCTCAAAACTT-------GGCGGGGTGGAGGGGCCCCTAGGAGCGCCTTGGTGGGA  Δ7
CACCTCCCTATCCTCAAAACTTG------GACGGGGTGGAGGGGCCCCTAGGAGCGCCTTGGTGGGA  Δ6
CACCTCCCTATCCTCAAAACTTGGCC--AGGCGGGGTGGAGGGGCCCCTAGGAGCGCCTTGGTGGGA  Δ2

CACCTCCCTATCCTCAAAACTTGGCCAGAGACTTANACCTAANACCTCAAACTATGAGACTGCTACNAGAGAACA
TCANAAAAACTTTCCAGGACATTCTTCTGGNGGGGTGGAGGGGCCCCTANGAGCGCCTTGNNGGGA  +74

CACCTCCCTATCCTCAAAACTTGGCCAGAGTCTACAGATTTATAAAATATTACCAGTTAATCATGACACATATTG
TTTATTTTCAAATATTTTTTCTAGTTAAACCCACCATTTATATAACCAATTATATTTGATATTATTTAAAATTTT
TGTATTAACACCCCACCAAATCATTTTACAGCGGGGTGGAGGGGCCCCTAGGAGCGCCTTGGTGGGA  +150
```

OT2-15
```
GTCGGTGCCCCACATGTGGCAGATGCCCAGAGGCGGGGTGTGGGGGGTACTTTGTGGGCGTTTTGGG  Wild-
type x79
GTCGGTGCCCCAC---------------------GCGGGGTGTGGGGGGTACTTTGTGGGCGTTTTGGG  Δ19
GTCGGTGCCCCACATGTGGC------------GCGGGGTGTGGGGGGTACTTTGTGGGCGTTTTGGG  Δ12
GTCGGTGCCCCACATGTGGCAGATGCCCAGA-----GGTGTGGGGGGTACTTTGTGGGCGTTTTGGG  Δ5
GTCGGTGCCCCACATGTGGCAGATGCCCA------GGGGTGTGGGGGGTACTTTGTGGGCGTTTTGGG  Δ5
GTCGGTGCCCCACATGTGGCAGATGCCCAGA-----GGGTGTGGGGGGTACTTTGTGGGCGTTTTGGG  Δ4
GTCGGTGCCCCACATGTGGCAGATGCCC----GCGGGGTGTGGGGGGTACTTTGTGGGCGTTTTGGG  Δ4
GTCGGTGCCCCACATGTGGCAGATGCCC--AGGCGGGGTGTGGGGGGTACTTTGTGGGCGTTTTGGG  Δ2 x2
```

OT2-24
```
GTCCCTCTGGGCCCCATCCTCCCCTCCCCACCCACCCCGCCTCAGGCTTGAAGAGGAAAGAAGAGCA
GTCCCTCTGGGCCCC----------------------------ANAGNANNNANNANNN  Δ36
GTCCCTCTGGGCCCCATCCTCCCCTCCCC-------------------TGAAGAGGAAAGAAGAGCG  Δ19
GTCCCTCTNNNCNNCNT-----------------CCNCNCCTCAGGCTTGAAGAGGAAAGAAGAGCG  Δ17
GTCCCTCTGGGCCCCATCCTCCCCTC--------------CCTCAGGCTTGAAGAGGAAAGAAGAGCG  Δ13
GTCCCTCTGGGCCCCATCCTCCCCTCCCCA-----------CTCAGGCTTGAAGAGGAAAGAAGAGCG  Δ10
GTCCCTCNNNNNNNCCTCCTCCCC---------NNCCCNCNCTCAGGCTTGAAGAGGAAAGAAGAGCG  Δ8
GTCCCTCTGGGCCCCATCCTCCCCTCCCCACCCA------CTCAGGCTTGAAGAGGAAAGAAGAGCG  Δ6
GTCCCTCTGGGCCCCATCCTCCCCTCCCCACCCA-----CCTCAGGCTTGAAGAGGAAAGAAGAGCG  Δ5

GTCCCTCTGGGCCCCATCCTCCCCTCCCCACCCACCCCG*CATCGTACGTGTCCTTACTAAGCTGCAATTTGGCAT*
*CTTCAGCTAAGTCGAAGTTCGA*CCTCAGGCTTGAAGAGGAAAGAAGAGCG  +58
```

Fig. 9C

Target 3 (*VEGFA* Site 3):

OT3-2*
GAGAGCGAGTGAGTGAGTGAGTGAGTGTGTGTGTGGGGGGGACTCGGCTTGTTGTTGTCGGTGACTT Wild-type x26
GAGAGCGAGTGAGTGAGTGAGTGAGTGTGNGTNTNNNNATTTCACACAACATACGAGCCGGAAGCATAAAGTGTA
AAGCCTAGGGTGCCTAATGAGTGAGCTAACTCACATTAATTGCGTTGCGCTCACTGCCCGCTTTCCAGTCGGGAA
ACCTGTCGTGCCAGCTGCATTAATGAATCGGCCAANNNNNGNNNAGAGGCGGTTTGCGTATTGGGCGCTCTTCCG
CTTCCTCGCTCACTGACTCGCTGCGCTCGGTCGTTCGGCTGCGGCGAGCGGTATCAGCTCACTCAAAGGCGGTAA
TACGGTTATCCACANAANGGGACTCGGCTTGTTGTTGTCGGTGACTT +280

OT3-9
TGGAGGTGTTGGGATGCGGGAGTGGGTGAGTGAGTGCGTGCGGGTGGCGATGCAAGCGTGTGCGAAT Wild-type x101
TGGAGGTGTTGGGATGCGGGAGTGG--------GTGCGTGCGGGTGGCGATGCAAGCGTGTGCGAAT Δ8
TGGAGGTGTTGGGATGCGGGAGTGGGTGA--------GTGCGGGTGGCGATGCAAGCGTGTGCGAAT Δ8

OT3-18
CAAAGACAGTAGATCTTAAATGTCCTCACGCACACACTCACCCACACATAAAAGGTGGTAACTGTGT Wild-type x64
CAAAGACAGTAGATCTTAA-----------GCACACACTCACCCACACATAAAAGGTGGTAACTGTGT Δ10
CAAAGACAGTAGATCTTAAATGTCCTCACG--------TCACCCACACATAAAAGGTGGTAACTGTGT Δ7
CAAAGACAGTAGATCTTAAATGTC-----GCACACACTCACCCACACATAAAAGGTGGTAACTGTGT Δ5
CAAAGACAGTAGATCTTAAATGTCCTCACGCCGACNATTGCATGAAGAATCTGCTTAGGGTTAGGCGTTTTGCGC
TGCTTCGCGATGTACGGGCCAGATAGCACACACTCACCCACACATAAAAGGTGGTAACTGTGT +71

CAAAGACAGTAGATCTTAAATGTCCTCACGCAAATTTTATTTTGGTTCATGATATGGCTTGGCGTGTATGCTTTT
CATTTGTAAAATTGCTGTTCTTTTGACAATTTAAGTGACTGTTTCATTGACTACAAGTTTGAAAATAAAAATTAA
TTAAGAAAAAAATTCCAATGACTGTGCTGTGGTTGGGCACACACTCACCCACACATAAAAGGTGGTAACTGTGT
+157

CAAAGACAGTAGATCTTAAATGTCCTCACGTGGAAACATAGTAGATGAGGTGGCATATCATGAAAAGTACCCAAC
GATTTATCACCTCANAAAAAAGCTAGTTGACTCAACTGATAAAGCGGACCTGAGGTTAATCTACTTGGCTCTTGC
CCATATGATAAAGTTCCGTGGGCACTTTCTCATTGAGGGTGATCTAAATCCGGACAACTCGGATGTCGAGCACAC
ACTCACCCACACATAAAAGGTGGTAACTGTGT +190
CAAAGACAGTAGATCTTAAATGTCCTCACG---------------
TTATTTAGAGACAGAGTCTCACTCTGTTGCCCAGGCTGGGGTGCAGTGGTACGAACTCGGCTCACTGCAACCTCC
GTCTCCTGGGCTCAAGTGATTATCCTGCCTCAGCCTCCCGAGTAGCTGGGATTACAGGTGCCCACCACCACACCC
GGCTAATTTTTGTATTTTCAGTAGAGCTGGGGTTTCACCATGTTGGCCAGCCTGTTCTCGGCACACACTCACCCA
CACATAAAAGGTGGTAACTGTGT +211 (Δ16 +227)

Target 4 (*EMX1*):

OT4-1
GATTGCCTTTACTCCATGCCTTTCTTCTTCTGCTCTAACTCTGACAATCTGTCTTGCCATGCCATAA Wild-type x74
GATTGCCTTTACTC----------CTTCTTCTGCTCTAACTCTGACAATCTGTCTTGCCATGCCATAA Δ9
GATTGCCTTTACTCCATGCCT------TTCTGCTCTAACTCTGACAATCTGTCTTGCCATGCCATAA Δ6 x2
GATTGCCTTTACTCCATGC------TCTTCTGCTCTAACTCTGACAATCTGTCTTGCCATGCCATAA Δ6
GATTGCCTTTACTCCATGCCT----TTCTTCTGCTCTAACTCTGACAATCTGTCTTGCCATGCCATAA Δ3 x3

USING TRUNCATED GUIDE RNAS (TRU-GRNAS) TO INCREASE SPECIFICITY FOR RNA-GUIDED GENOME EDITING

CLAIM OF PRIORITY

This application is a U.S. National Phase Application under 35 U.S.C. § 371 of International Patent Application No. PCT/US2014/029068, filed on Mar. 14, 2014, which claims the benefit of U.S. Patent Application Serial Nos. 61/799,647, filed on Mar. 15, 2013; 61/838,178, filed on Jun. 21, 2013; 61/838,148, filed on Jun. 21, 2013, and 61/921,007, filed on Dec. 26, 2013. The entire contents of the foregoing are hereby incorporated by reference.

FEDERALLY SPONSORED RESEARCH OR DEVELOPMENT

This invention was made with Government support under Grant Nos. DP1 GM105378 awarded by the National Institutes of Health. The Government has certain rights in the invention.

TECHNICAL FIELD

Methods for increasing specificity of RNA-guided genome editing, e.g., editing using CRISPR/Cas9 systems, using truncated guide RNAs (tru-gRNAs).

BACKGROUND

Recent work has demonstrated that clustered, regularly interspaced, short palindromic repeats (CRISPR)/CRISPR-associated (Cas) systems (Wiedenheft et al., Nature 482, 331-338 (2012); Horvath et al., Science 327, 167-170 (2010); Terns et al., Curr Opin Microbiol 14, 321-327 (2011)) can serve as the basis for performing genome editing in bacteria, yeast and human cells, as well as in vivo in whole organisms such as fruit flies, zebrafish and mice (Wang et al., Cell 153, 910-918 (2013); Shen et al., Cell Res (2013); Dicarlo et al., Nucleic Acids Res (2013); Jiang et al., Nat Biotechnol 31, 233-239 (2013); Jinek et al., Elife 2, e00471 (2013); Hwang et al., Nat Biotechnol 31, 227-229 (2013); Cong et al., Science 339, 819-823 (2013); Mali et al., Science 339, 823-826 (2013c); Cho et al., Nat Biotechnol 31, 230-232 (2013); Gratz et al., Genetics 194(4):1029-35 (2013)). The Cas9 nuclease from *S. pyogenes* (hereafter simply Cas9) can be guided via base pair complementarity between the first 20 nucleotides of an engineered guide RNA (gRNA) and the complementary strand of a target genomic DNA sequence of interest that lies next to a protospacer adjacent motif (PAM), e.g., a PAM matching the sequence NGG or NAG (Shen et al., Cell Res (2013); Dicarlo et al., Nucleic Acids Res (2013); Jiang et al., Nat Biotechnol 31, 233-239 (2013); Jinek et al., Elife 2, e00471 (2013); Hwang et al., Nat Biotechnol 31, 227-229 (2013); Cong et al., Science 339, 819-823 (2013); Mali et al., Science 339, 823-826 (2013c); Cho et al., Nat Biotechnol 31, 230-232 (2013); Jinek et al., Science 337, 816-821 (2012)). Previous studies performed in vitro (Jinek et al., Science 337, 816-821 (2012)), in bacteria (Jiang et al., Nat Biotechnol 31, 233-239 (2013)) and in human cells (Cong et al., Science 339, 819-823 (2013)) have shown that Cas9-mediated cleavage can, in some cases, be abolished by single mismatches at the gRNA/target site interface, particularly in the last 10-12 nucleotides (nts) located in the 3' end of the 20 nt gRNA complementarity region.

SUMMARY

CRISPR-Cas genome editing uses a guide RNA, which includes both a complementarity region (which binds the target DNA by base-pairing) and a Cas9-binding region, to direct a Cas9 nuclease to a target DNA (see FIG. 1). The nuclease can tolerate a number of mismatches (up to five, as shown herein) in the complementarity region and still cleave; it is hard to predict the effects of any given single or combination of mismatches on activity. Taken together, these nucleases can show significant off-target effects but it can be challenging to predict these sites. Described herein are methods for increasing the specificity of genome editing using the CRISPR/Cas system, e.g., using Cas9 or Cas9-based fusion proteins. In particular, provided are truncated guide RNAs (tru-gRNAs) that include a shortened target complementarity region (i.e., less than 20 nts, e.g., 17-19 or 17-18 nts of target complementarity, e.g., 17, 18 or 19 nts of target complementarity), and methods of using the same. As used herein, “17-18 or 17-19” includes 17, 18, or 19 nucleotides.

In one aspect, the invention provides a guide RNA molecule (e.g., a single guide RNA or a crRNA) having a target complementarity region of 17-18 or 17-19 nucleotides, e.g., the target complementarity region consists of 17-18 or 17-19 nucleotides, e.g., the target complementarity region consists of 17-18 or 17-19 nucleotides of consecutive target complementarity. In some embodiments, the guide RNA includes a complementarity region consisting of 17-18 or 17-19 nucleotides that are complementary to 17-18 or 17-19 consecutive nucleotides of the complementary strand of a selected target genomic sequence. In some embodiments, the target complementarity region consists of 17-18 nucleotides (of target complementarity). In some embodiments, the complementarity region is complementary to 17 consecutive nucleotides of the complementary strand of a selected target sequence. In some embodiments, the complementarity region is complementary to 18 consecutive nucleotides of the complementary strand of a selected target sequence.

In another aspect, the invention provides a ribonucleic acid consisting of the sequence:

(SEQ ID NO: 2404)
($X_{17-18}$ or $X_{17-19}$)GUUUUAGAGCUA;

(SEQ ID NO: 2407)
($X_{17-18}$ or $X_{17-19}$)GUUUUAGAGCUAUGCUGUUUUG;
or (SEQ ID NO: 2408)
($X_{17-18}$ or $X_{17-19}$)GUUUUAGAGCUAUGCU;

(SEQ ID NO: 1)
($X_{17-18}$ or $X_{17-19}$)GUUUUAGAGCUAGAAAUAGCAAGUUAAAAUAAGGCUAGUCCG($X_N$);

(SEQ ID NO: 2)
($X_{17-18}$ or $X_{17-19}$)GUUUUAGAGCUAUGCUGAAAAGCAUAGCAAGUUAAAAUAAGGCUAGUCCGUUAUC($X_N$);

(SEQ ID NO: 3)
($X_{17-18}$ or $X_{17-19}$)GUUUUAGAGCUAUGCUGUUUUGGAAACAAAACAGCAUAGCAAGUUAAAAUAAGGCUAGUCCGUUAUC($X_N$);

-continued (SEQ ID NO: 4)
(X₁₇₋₁₈) GUUUUAGAGCUAGAAAUAGCAAGUUAAAAUAAGGCUAGUCCG

UUAUCAACUUGAAAAAGUGGCACCGAGUCGGUGC (X_N), (SEQ ID NO: 5)
(X₁₇₋₁₈ or X₁₇₋₁₉) GUUUAAGAGCUAGAAAUAGCAAGUUUAAAUAA

GGCUAGUCCGUUAUCAACUUGAAAAAGUGGCACCGAGUCGGUGC;

(SEQ ID NO: 6)
(X₁₇₋₁₈ or X₁₇₋₁₉) GUUUUAGAGCUAUGCUGGAAACAGCAUAGCAA

GUUUAAAUAAGGCUAGUCCGUUAUCAACUUGAAAAGUGGCACCGAGUCG

GUGC;
or (SEQ ID NO: 7)
(X₁₇₋₁₈ or X₁₇₋₁₉) GUUUAAGAGCUAUGCUGGAAACAGCAUAGCAA

GUUUAAAUAAGGCUAGUCCGUUAUCAACUUGAAAAGUGGCACCGAGUCG

GUGC;

wherein $X_{17\text{-}18}$ or $X_{17\text{-}19}$ is a sequence (of 17-18 or 17-19 nucleotides) complementary to the complementary strand of a selected target sequence, preferably a target sequence immediately 5' of a protospacer adjacent motif (PAM), e.g., NGG, NAG, or NNGG (see, for example, the configuration in FIG. 1), and $X_N$ is any sequence, wherein N (in the RNA) can be 0-200, e.g., 0-100, 0-50, or 0-20, that does not interfere with the binding of the ribonucleic acid to Cas9. In no case is the $X_{17\text{-}18}$ or $X_{17\text{-}19}$ identical to a sequence that naturally occurs adjacent to the rest of the RNA. In some embodiments the RNA includes one or more U, e.g., 1 to 8 or more Us (e.g., U, UU, UUU, UUUU, UUUUU, UUUUUU, UUUUUUU, UUUUUUUU) at the 3' end of the molecule, as a result of the optional presence of one or more Ts used as a termination signal to terminate RNA PolIII transcription. In some embodiments the RNA includes one or more, e.g., up to 3, e.g., one, two, or three, additional nucleotides at the 5' end of the RNA molecule that is not complementary to the target sequence. In some embodiments, the target complementarity region consists of 17-18 nucleotides (of target complementarity). In some embodiments, the complementarity region is complementary to 17 consecutive nucleotides of the complementary strand of a selected target sequence. In some embodiments, the complementarity region is complementary to 18 consecutive In another aspect, the invention provides DNA molecules encoding the ribonucleic acids described herein, and host cells harboring or expressing the ribonucleic acids or vectors.

In a further aspect, the invention provides methods for increasing specificity of RNA-guided genome editing in a cell, the method comprising contacting the cell with a guide RNA that includes a complementarity region consisting of 17-18 or 17-19 nucleotides that are complementary to 17-18 or 17-19 consecutive nucleotides of the complementary strand of a selected target genomic sequence, as described herein.

In yet another aspect, the invention provides methods for inducing a single or double-stranded break in a target region of a double-stranded DNA molecule, e.g., in a genomic sequence in a cell. The methods include expressing in or introducing into the cell: a Cas9 nuclease or nickase; and a guide RNA that includes a sequence consisting of 17 or 18 or 19 nucleotides that are complementary to the complementary strand of a selected target sequence, preferably a target sequence immediately 5' of a protospacer adjacent motif (PAM), e.g., NGG, NAG, or NNGG, e.g., a ribonucleic acid as described herein.

Also provided herein are methods for modifying a target region of a double-stranded DNA molecule in a cell. The methods include expressing in or introducing into the cell: a dCas9-heterologous functional domain fusion protein (dCas9-HFD); and a guide RNA that includes a complementarity region consisting of 17-18 or 17-19 nucleotides that are complementary to 17-18 or 17-19 consecutive nucleotides of the complementary strand of a selected target genomic sequence, as described herein.

In some embodiments, the guide RNA is (i) a single guide RNA that includes a complementarity region consisting of 17-18 or 17-19 nucleotides that are complementary to 17-18 or 17-19 consecutive nucleotides of the complementary strand of a selected target genomic sequence, or (ii) a crRNA that includes a complementarity region consisting of 17-18 or 17-19 nucleotides that are complementary to 17-18 or 17-19 consecutive nucleotides of the complementary strand of a selected target genomic sequence, and a tracrRNA.

In some embodiments, the target complementarity region consists of 17-18 nucleotides (of target complementarity). In some embodiments, the complementarity region is complementary to 17 consecutive nucleotides of the complementary strand of a selected target sequence. In some embodiments, the complementarity region is complementary to 18 consecutive In no case is the $X_{17\text{-}18}$ or $X_{17\text{-}19}$ of any of the molecules described herein identical to a sequence that naturally occurs adjacent to the rest of the RNA. In some embodiments the RNA includes one or more U, e.g., 1 to 8 or more Us (e.g., U, UU, UUU, UUUU, UUUUU, UUUUUU, UUUUUUU, UUUUUUUU) at the 3' end of the molecule, as a result of the optional presence of one or more Ts used as a termination signal to terminate RNA PolIII transcription. In some embodiments the RNA includes one or more, e.g., up to 3, e.g., one, two, or three, additional nucleotides at the 5' end of the RNA molecule that is not complementary to the target sequence.

In some embodiments, one or more of the nucleotides of the RNA is modified, e.g., locked (2'-O-4'-C methylene bridge), is 5'-methylcytidine, is 2'-O-methyl-pseudouridine, or in which the ribose phosphate backbone has been replaced by a polyamide chain, e.g., one or more of the nucleotides within or outside the target complementarity region $X_{17\text{-}18}$ or $X_{17\text{-}19}$. In some embodiments, some or all of the tracrRNA or crRNA, e.g., within or outside the $X_{17\text{-}18}$ or $X_{17\text{-}19}$ target complementarity region, comprises deoxyribonucleotides (e.g., is all or partially DNA, e.g. DNA/RNA hybrids).

In an additional aspect, the invention provides methods for modifying a target region of a double-stranded DNA molecule, e.g., in a genomic sequence in a cell. The methods include expressing in or introducing into the cell:
a dCas9-heterologous functional domain fusion protein (dCas9-HFD); and
a guide RNA that includes a sequence consisting of 17-18 or 17-19 nucleotides that are complementary to the complementary strand of a selected target sequence, preferably a target sequence immediately 5' of a protospacer adjacent motif (PAM), e.g., NGG, NAG, or NNGG, e.g., a ribonucleic acid as described herein. In no case is the $X_{17\text{-}18}$ or $X_{17\text{-}19}$ identical to a sequence that naturally occurs adjacent to the rest of the RNA. In some embodiments the RNA includes one or more, e.g., up to 3, e.g., one, two, or three, additional nucleotides at the 5' end of the RNA molecule that is not complementary to the target sequence.

In another aspect, the invention provides methods for modifying, e.g., introducing a sequence specific break into, a target region of a double-stranded DNA molecule, e.g., in a genomic sequence in a cell. The methods include expressing in or introducing into the cell: a Cas9 nuclease or nickase, or a dCas9-heterologous functional domain fusion protein (dCas9-HFD);
a tracrRNA, e.g., comprising or consisting of the sequence GGAACCAUUCAAAACAGCAUAG-CAAGUUAAAAUAAGGCUAGUCCGUUA UCAAC-UUGAAAAAGUGGCACCGAGUCGGUGC (SEQ ID NO:8) or an active portion thereof;
UAGCAAGUUAAAAUAAGGCUAGUCCGUUAU-CAACUUGAAAAGUGGCA CCGAGUCGGUGC (SEQ ID NO:2405) or an active portion thereof;
AGCAUAGCAAGUUAAAAUAAGGCUAGUC-CGUUAUCAACUUGAAAAAGU GGCACCGAGUCG-GUGC (SEQ ID NO:2407) or an active portion thereof;
CAAAACAGCAUAGCAAGUUAAAAUAAGGCUAGU-CCGUUAUCAACUUGA AAAAGUGGCACCGAGUCG-GUGC (SEQ ID NO:2409) or an active portion thereof;
UAGCAAGUUAAAAUAAGGCUAGUCCGUUAU-CAACUUGAAAAAGUG (SEQ ID NO:2410) or an active portion thereof;
UAGCAAGUUAAAAUAAGGCUAGUCCGUUAUCA (SEQ ID NO:2411) or an active portion thereof; or
UAGCAAGUUAAAAUAAGGCUAGUCCG (SEQ ID NO:2412) or an active portion thereof; and
a crRNA that includes a sequence consisting of 17-18 or 17-19 nucleotides that are complementary to the complementary strand of a selected target sequence, preferably a target sequence immediately 5' of a protospacer adjacent motif (PAM), e.g., NGG, NAG, or NNGG; in some embodiments the crRNA has the sequence:

(SEQ ID NO: 2404)
($X_{17-18}$ or $X_{17-19}$)GUUUUAGAGCUA;

(SEQ ID NO: 2407)
($X_{17-18}$ or $X_{17-19}$)GUUUUAGAGCUAUGCUGUUUUG;
or (SEQ ID NO: 2408)
($X_{17-18}$ or $X_{17-19}$)GUUUUAGAGCUAUGCU.

In some embodiments the crRNA is ($X_{17-18}$ or $X_{17-19}$) GUUUUAGAGCUAUGCUGUUUUG (SEQ ID NO:2407) and the tracrRNA is GGAACCAUUCAAAACAGCAUAG-CAAGUUAAAAUAAGGCUAGUCCGUUA UCAAC-UUGAAAAAGUGGCACCGAGUCGGUGC (SEQ ID NO:8); the cRNA is ($X_{17-18}$ or $X_{17-19}$)GUUUUAGAGCUA (SEQ ID NO:2404) and the tracrRNA is UAG-CAAGUUAAAAUAAGGCUAGUCCGUUAUCAAC-UUGAAAAAGUGGCA CCGAGUCGGUGC (SEQ ID NO:2405); or the cRNA is ($X_{17-18}$ or $X_{17-19}$) GUUUUA-GAGCUAUGCU (SEQ ID NO:2408) and the tracrRNA is AGCAUAGCAAGUUAAAAUAAGGCUAGUC-CGUUAUCAACUUGAAAAAGU GGCACCGAGUCG-GUGC (SEQ ID NO:2406).

In no case is the $X_{17-18}$ or $X_{17-19}$ identical to a sequence that naturally occurs adjacent to the rest of the RNA. In some embodiments the RNA (e.g., tracrRNA or crRNA) includes one or more U, e.g., 2 to 8 or more Us (e.g., U, UU, UUU, UUUU, UUUUU, UUUUUU, UUUUUUU, UUUUUUUU) at the 3' end of the molecule, as a result of the optional presence of one or more Ts used as a termination signal to terminate RNA PolIII transcription. In some embodiments the RNA (e.g., tracrRNA or crRNA) includes one or more, e.g., up to 3, e.g., one, two, or three, additional nucleotides at the 5' end of the RNA molecule that is not complementary to the target sequence. In some embodiments, one or more of the nucleotides of the crRNA or tracrRNA is modified, e.g., locked (2'-O-4'-C methylene bridge), is 5'-methylcytidine, is 2'-O-methyl-pseudouridine, or in which the ribose phosphate backbone has been replaced by a polyamide chain, e.g., one or more of the nucleotides within or outside the sequence $X_{17-18}$ or $X_{17-19}$. In some embodiments, some or all of the tracrRNA or crRNA, e.g., within or outside the $X_{17-18}$ or $X_{17-19}$ target complementarity region, comprises deoxyribonucleotides (e.g., is all or partially DNA, e.g. DNA/RNA hybrids).

In some embodiments, the dCas9-heterologous functional domain fusion protein (dCas9-HFD) comprises a HFD that modifies gene expression, histones, or DNA, e.g., transcriptional activation domain, transcriptional repressors (e.g., silencers such as Heterochromatin Protein 1 (HP1), e.g., HP1α or HP1β), enzymes that modify the methylation state of DNA (e.g., DNA methyltransferase (DNMT) or TET proteins, e.g., TET1), or enzymes that modify histone subunit (e.g., histone acetyltransferases (HAT), histone deacetylases (HDAC), or histone demethylases). In preferred embodiments, the heterologous functional domain is a transcriptional activation domain, e.g., a VP64 or NF-κB p65 transcriptional activation domain; an enzyme that catalyzes DNA demethylation, e.g., a TET protein family member or the catalytic domain from one of these family members; or histone modification (e.g., LSD1, histone methyltransferase, HDACs, or HATs) or a transcription silencing domain, e.g., from Heterochromatin Protein 1 (HP1), e.g., HP1α or HP1β; or a biological tether, e.g., MS2, CRISPR/Cas Subtype Ypest protein 4 (Csy4) or lambda N protein. dCas9-HFD are described in a U.S. Provisional Patent Application Ser. No. 61/799,647, Filed on Mar. 15, 2013, U.S. Ser. No. 61/838,148, filed on Jun. 21, 2013, and PCT International Application No. PCT/US14/27335, all of which are incorporated herein by reference in its entirety.

In some embodiments, the methods described herein result in an indel mutation or sequence alteration in the selected target genomic sequence.

In some embodiments, the cell is a eukaryotic cell, e.g., a mammalian cell, e.g., a human cell.

Unless otherwise defined, all technical and scientific terms used herein have the same meaning as commonly understood by one of ordinary skill in the art to which this invention belongs. Methods and materials are described herein for use in the present invention; other, suitable methods and materials known in the art can also be used. The materials, methods, and examples are illustrative only and not intended to be limiting. All publications, patent applications, patents, sequences, database entries, and other references mentioned herein are incorporated by reference in their entirety. In case of conflict, the present specification, including definitions, will control.

Other features and advantages of the invention will be apparent from the following detailed description and figures, and from the claims.

```
                                          (SEQ ID NO: 9)
EGFP Site 1 GGGCACGGGCAGCTTGCCGGTGG (SEQ ID NO: 10)
EGFP Site 2 GATGCCGTTCTTCTGCTTGTCGG (SEQ ID NO: 11)
EGFP Site 3 GGTGGTGCAGATGAACTTCAGGG
```

Figure 2A:
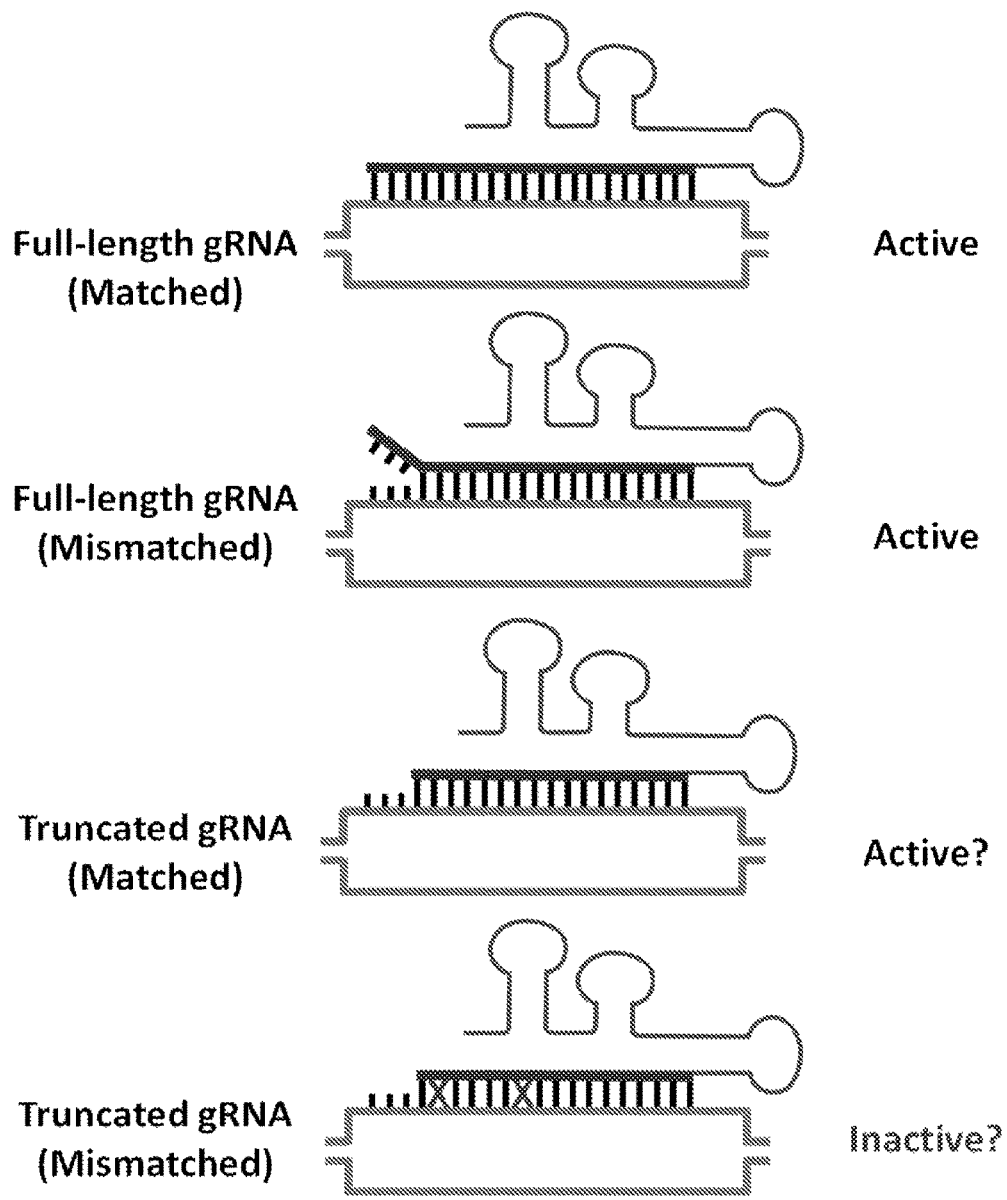
FIG. 2A: Schematic illustrating a rationale for truncating the 5' complementarity region of a gRNA. Thick grey lines=target DNA site, thin dark grey line structure=gRNA, black lines show base pairing (or lack thereof) between gRNA and target DNA site.
Figure 2B:
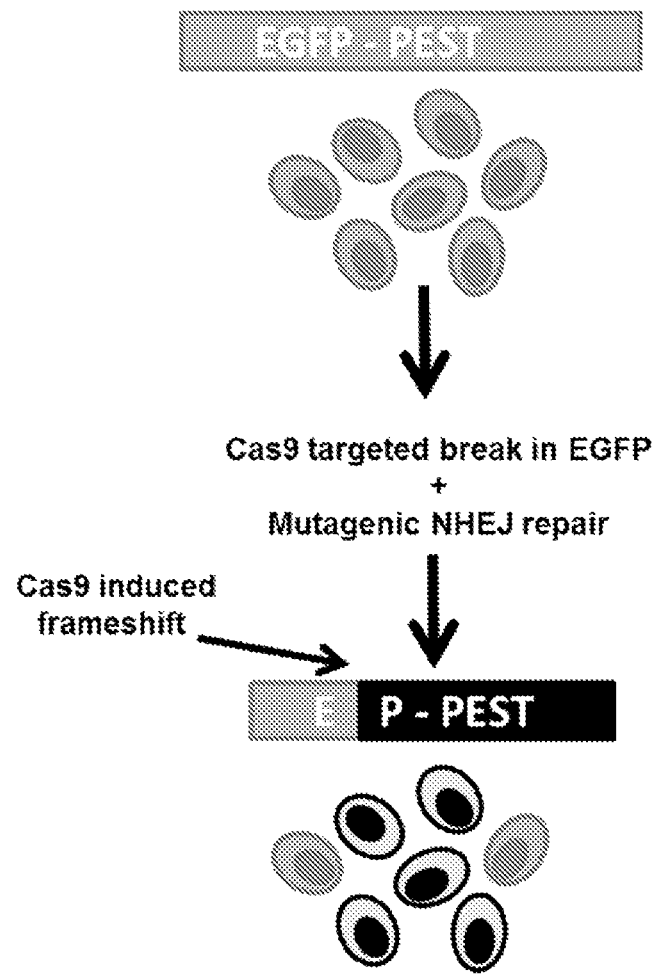
FIG. 2B: Schematic overview of the EGFP disruption assay. Repair of targeted Cas9-mediated double-stranded breaks in a single integrated EGFP-PEST reporter gene by error-prone NHEJ-mediated repair leads to frame-shift mutations that disrupt the coding sequence and associated loss of fluorescence in cells.
Figure 2C:
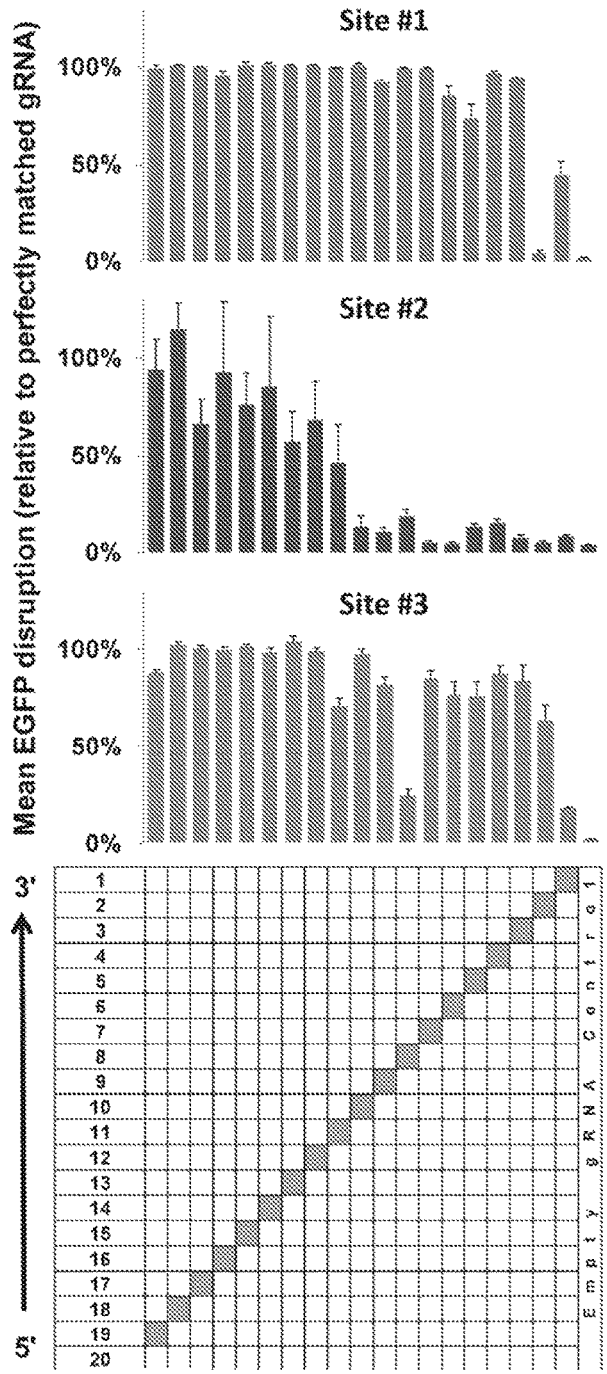
FIGS. 2C-F: Activities of RNA-guided nucleases (RGNs) harboring single guide RNAs (gRNAs) bearing (C) single mismatches, (D) adjacent double mismatches, (E) variably spaced double mismatches, and (F) increasing numbers of adjacent mismatches assayed on three different target sites in the EGFP reporter gene sequence. Mean activities of replicates are shown, normalized to the activity of a perfectly matched single gRNA. Error bars indicate standard errors of the mean. Positions mismatched in each single gRNA are highlighted in grey in the grid below. Sequences of the three EGFP target sites were as follows.
Figure 2D:
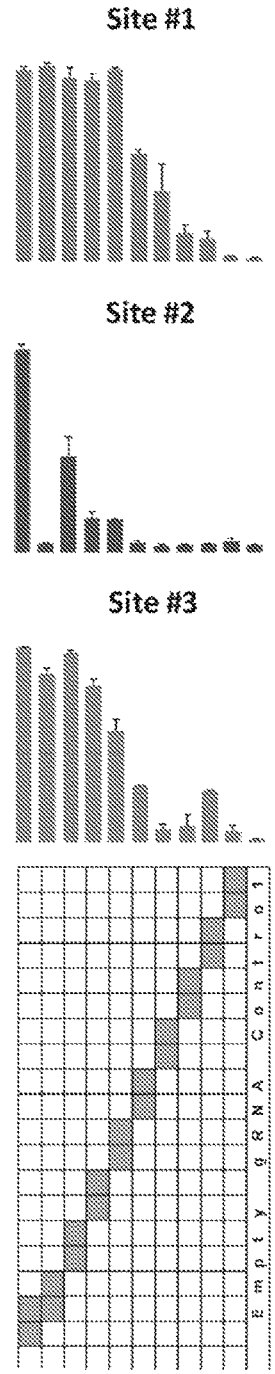
Figure 2E:
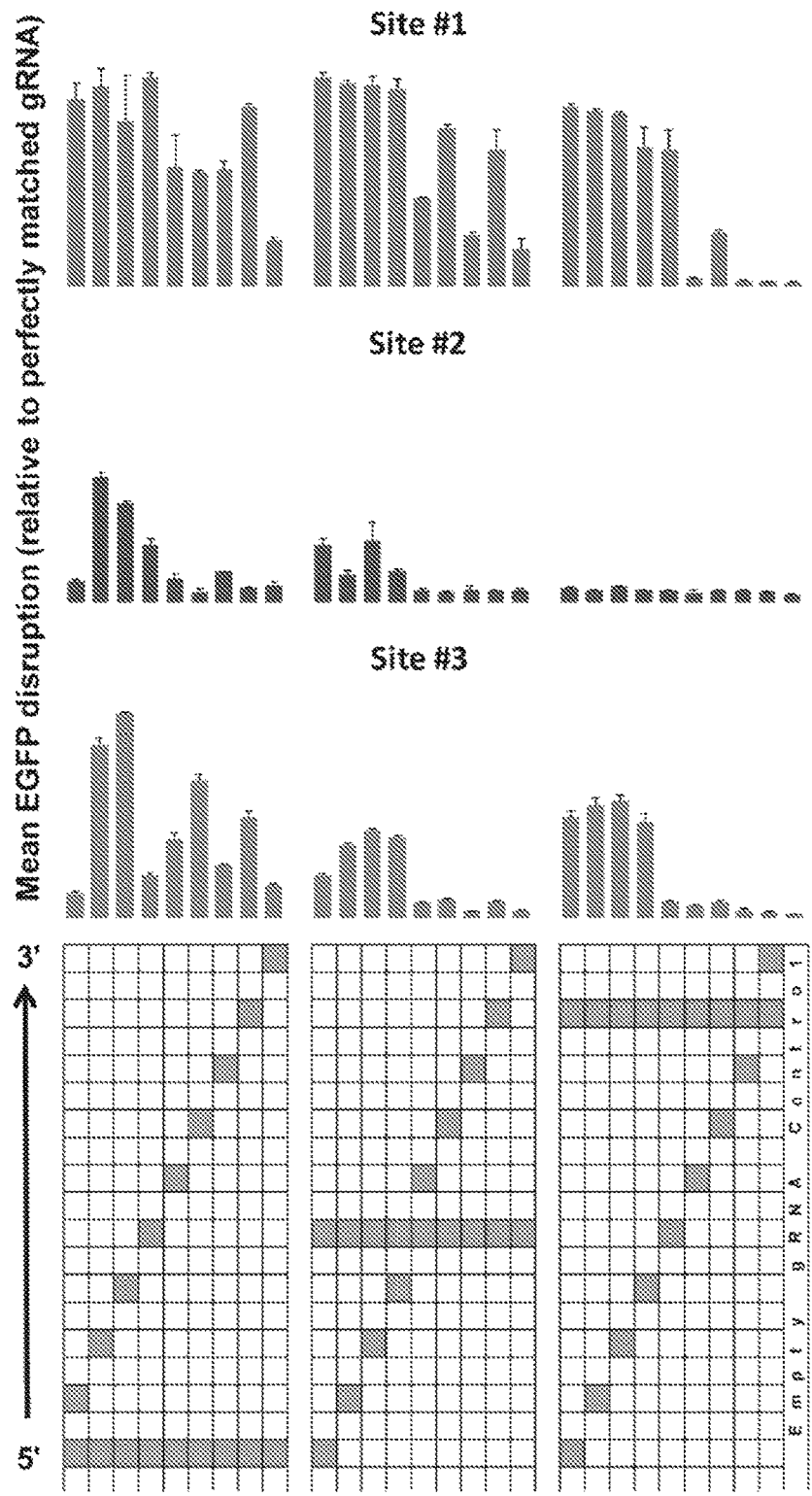
Figure 2F:
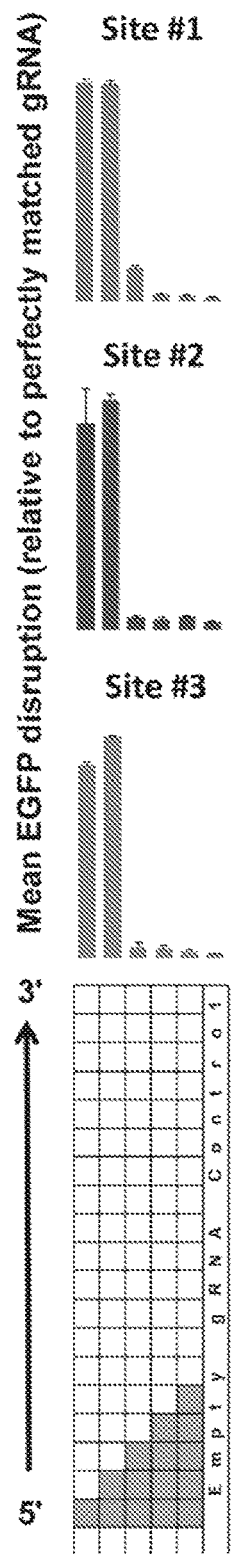
Figure 2G:
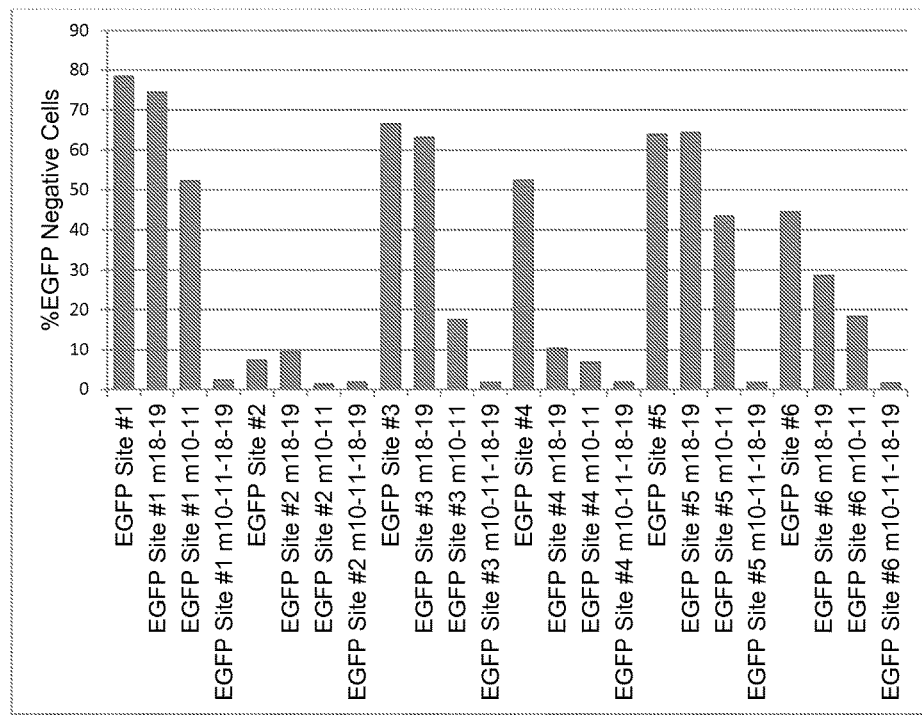

FIG. 2G: Mismatches at the 5' end of the gRNA make CRISPR/Cas more sensitive more 3' mismatches. The gRNAs Watson-Crick base pair between the RNA & DNA with the exception of positions indicated with an "m" which are mismatched using the Watson-Crick transversion (i.e., EGFP Site#2 M18-19 is mismatched by changing the gRNA to its Watson-Crick partner at positions 18 & 19. Although positions near the 5' of the gRNA are generally very well tolerated, matches in these positions are important for nuclease activity when other residues are mismatched. When all four positions are mismatched, nuclease activity is no longer detectable. This further demonstrates that matches at these 5' position can help compensate for mismatches at other more 3' positions. Note these experiments were performed with a non-codon optimized version of Cas9 which can show lower absolute levels of nuclease activity as compared to the codon optimized version.

Figure 2H:
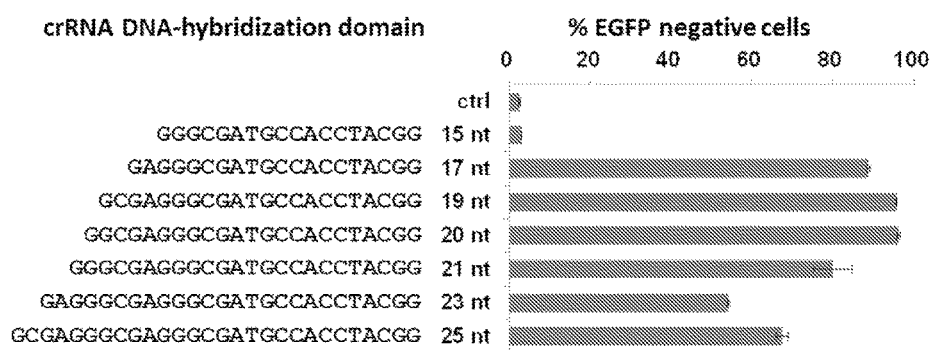

FIG. 2H: Efficiency of Cas9 nuclease activities directed by gRNAs bearing variable length complementarity regions ranging from 15 to 25 nts in a human cell-based U2OS EGFP disruption assay. Expression of a gRNA from the U6 promoter requires the presence of a 5' G and therefore it was only possible to evaluate gRNAs harboring certain lengths of complementarity to the target DNA site (15, 17, 19, 20, 21, 23, and 25 nts).

Figure 3A:
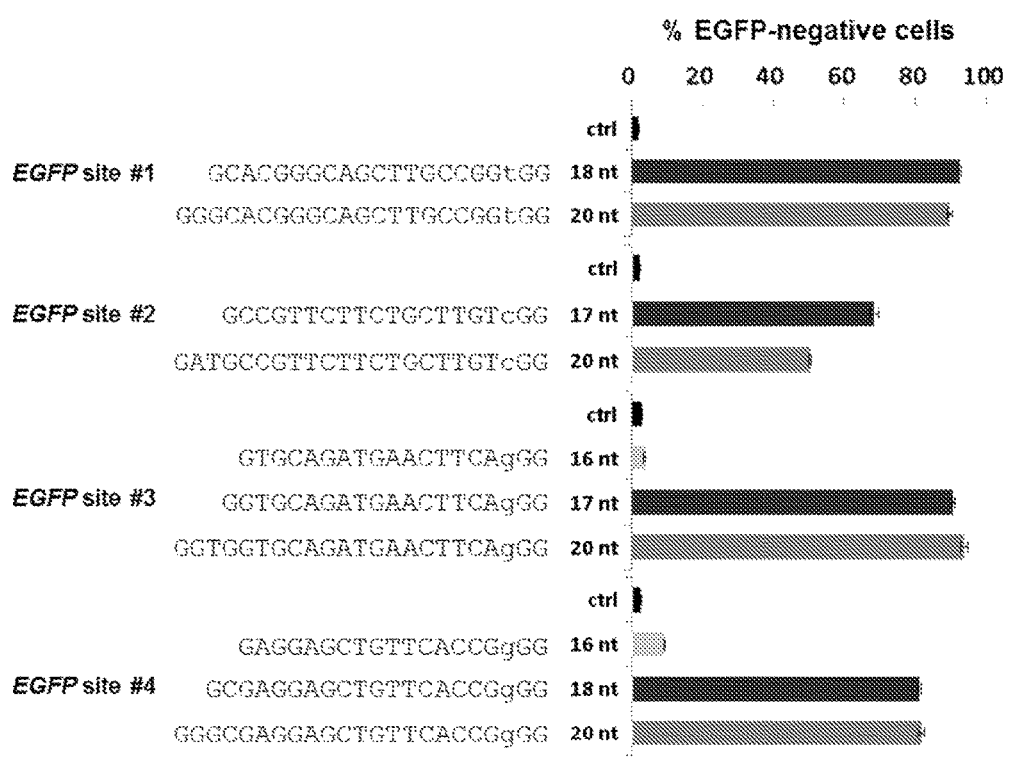

FIG. 3A: Efficiencies of EGFP disruption in human cells mediated by Cas9 and full-length or shortened gRNAs for four target sites in the EGFP reporter gene. Lengths of complementarity regions and corresponding target DNA sites are shown. Ctrl=control gRNA lacking a complementarity region.

Figure 3B:
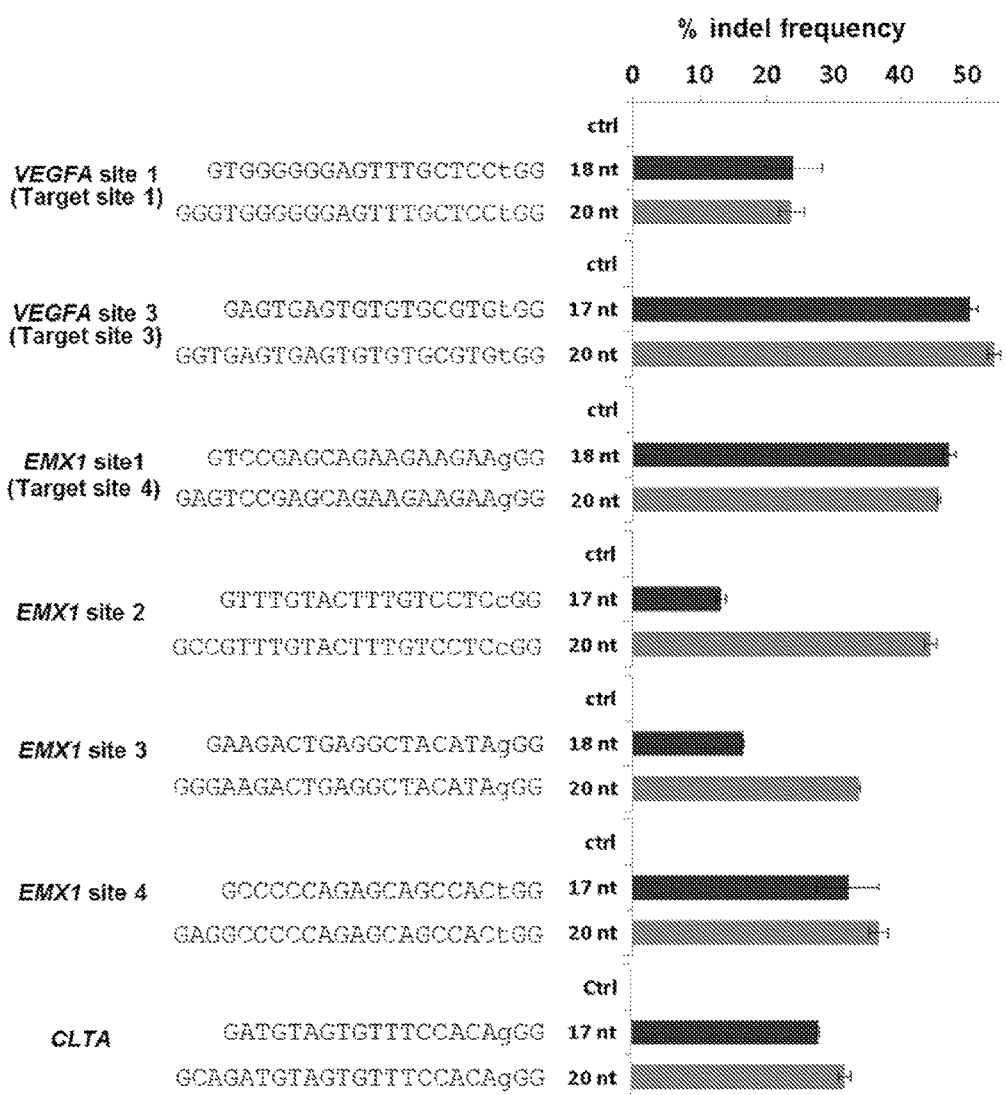

FIG. 3B: Efficiencies of targeted indel mutations introduced at seven different human endogenous gene targets by matched standard RGNs (Cas9 and standard full-length gRNAs) and tru-RGNs (Cas9 and gRNAs bearing truncations in their 5' complementarity regions). Lengths of gRNA complementarity regions and corresponding target DNA sites are shown. Indel frequencies were measured by T7EI assay. Ctrl=control gRNA lacking a complementarity region.

FIG. 3C: DNA sequences of indel mutations induced by RGNs using a tru-gRNA or a matched full-length gRNA targeted to the EMX1 site. The portion of the target DNA site that interacts with the gRNA complementarity region is highlighted in grey with the first base of the PAM sequence shown in lowercase. Deletions are indicated by dashes highlighted in grey and insertions by italicized letters highlighted in grey. The net number of bases deleted or inserted and the number of times each sequence was isolated are shown to the right.

Figure 3D:
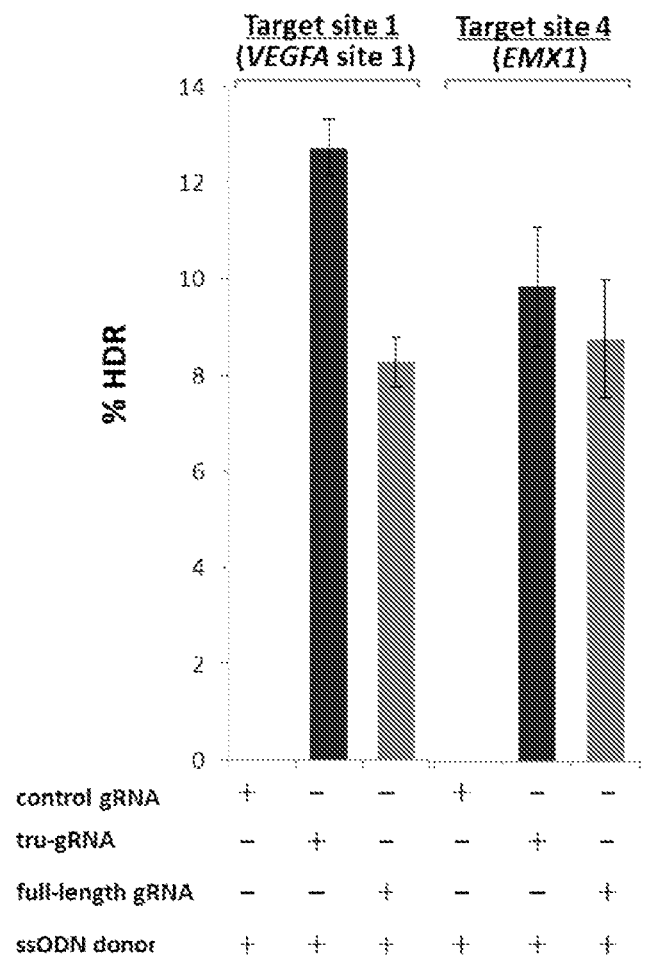

FIG. 3D: Efficiencies of precise HDR/ssODN-mediated alterations introduced at two endogenous human genes by matched standard and tru-RGNs. % HDR was measured using a BamHI restriction digest assay (see the Experimental Procedures for Example 2). Control gRNA=empty U6 promoter vector.

Figures 3E, 3F:
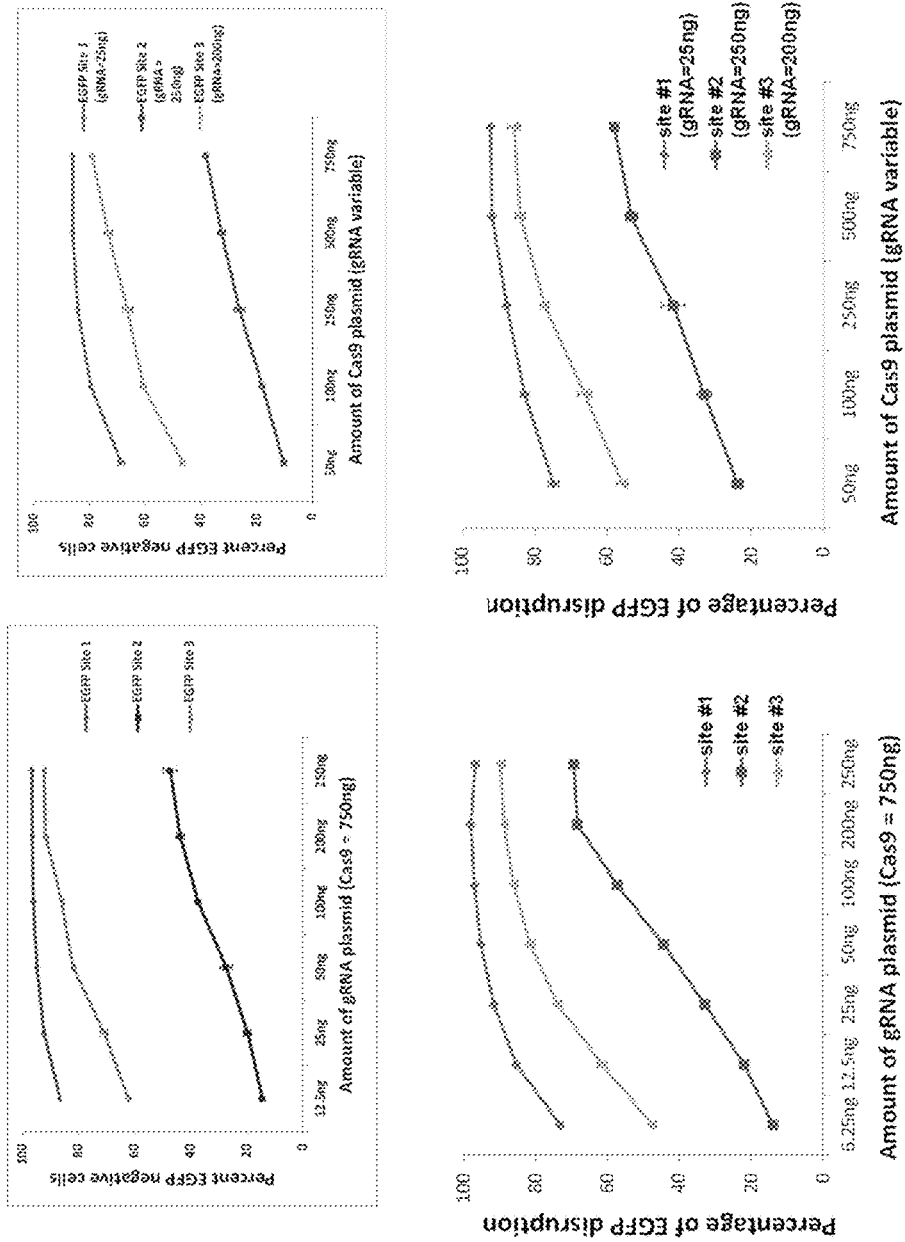

FIG. 3E: U2OS.EGFP cells were transfected with variable amounts of full-length gRNA expression plasmids (top) or tru-gRNA expression plasmids (bottom) together with a fixed amount of Cas9 expression plasmid and then assayed for percentage of cells with decreased EGFP expression. Mean values from duplicate experiments are shown with standard errors of the mean. Note that the data obtained with tru-gRNA matches closely with data from experiments performed with full-length gRNA expression plasmids instead of tru-gRNA plasmids for these three EGFP target sites.

FIG. 3F: U2OS.EGFP cells were transfected with variable amount of Cas9 expression plasmid together with fixed amounts of full-length gRNA expression plasmids (top) or tru-gRNA expression plasmids (bottom) for each target (amounts determined for each tru-gRNA from the experiments of FIG. 3E). Mean values from duplicate experiments are shown with standard errors of the mean. Note that the data obtained with tru-gRNA matches closely with data from experiments performed with full-length gRNA expression plasmids instead of tru-gRNA plasmids for these three EGFP target sites. The results of these titrations determined the concentrations of plasmids used in the EGFP disruption assays performed in Examples 1 and 2.

FIG. 4A: Schematic illustrating locations of VEGFA sites 1 and 4 targeted by gRNAs for paired double nicks. Target sites for the full-length gRNAs are underlined with the first base in the PAM sequence shown in lowercase. Location of the BamHI restriction site inserted by HDR with a ssODN donor is shown.

FIG. 4B: A tru-gRNA can be used with a paired nickase strategy to efficiently induce indel mutations. Substitution of a full-length gRNA for VEGFA site 1 with a tru-gRNA does not reduce the efficiency of indel mutations observed with a paired full-length gRNA for VEGFA site 4 and Cas9-D10A nickases. Control gRNA used is one lacking a complementarity region.

FIG. 4C: A tru-gRNA can be used with a paired nickase strategy to efficiently induce precise HDR/ssODN-mediated sequence alterations. Substitution of a full-length gRNA for VEGFA site 1 with a tru-gRNA does not reduce the efficiency of indel mutations observed with a paired full-length gRNA for VEGFA site 4 and Cas9-D10A nickases with an ssODN donor template. Control gRNA used is one lacking a complementarity region.

Figure 5A:
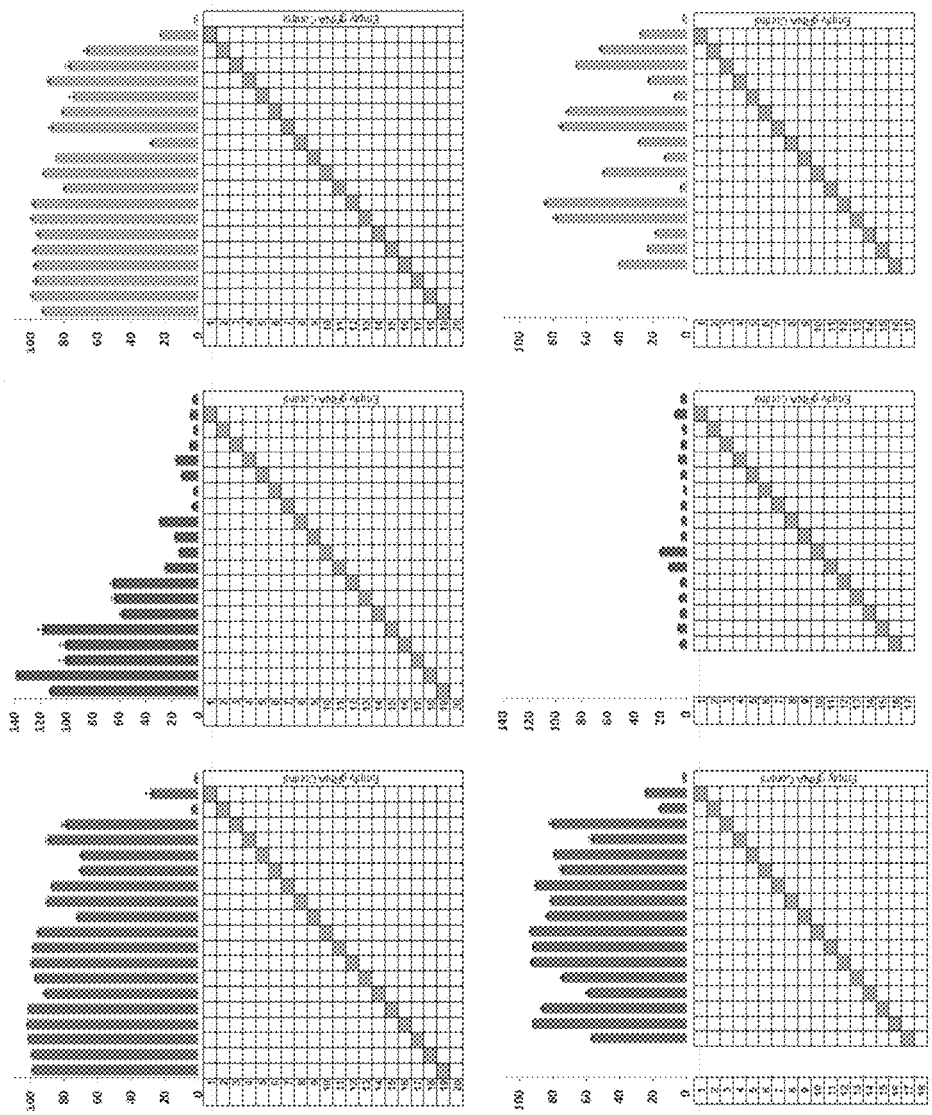

FIG. 5A: Activities of RGNs targeted to three sites in EGFP using full-length (top) or tru-gRNAs (bottom) with single mismatches at each position (except at the 5'-most base which must remain a G for efficient expression from the U6 promoter). Grey boxes in the grid below represent positions of the Watson-Crick transversion mismatches. Empty gRNA control used is a gRNA lacking a complementarity region. RGN activities were measured using the EGFP disruption assay and values shown represent the percentage of EGFP-negative observed relative to an RGN using a perfectly matched gRNA. Experiments were performed in duplicate and means with error bars representing standard errors of the mean are shown.

Figure 5B:
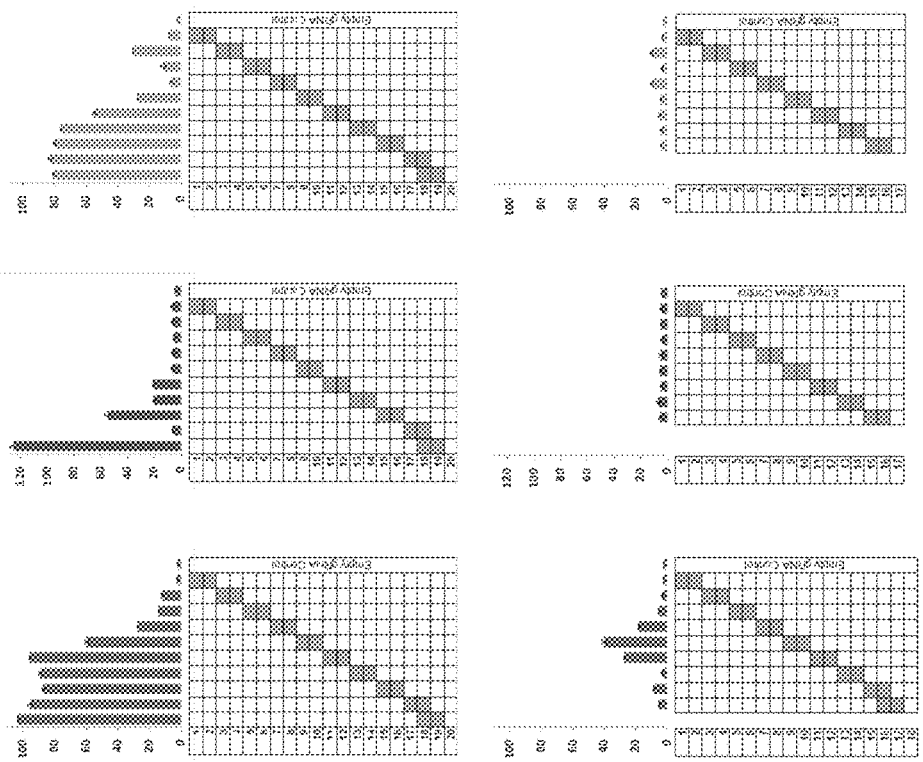

FIG. 5B: Activities of RGNs targeted to three sites in EGFP using full-length (top) or tru-gRNAs (bottom) with adjacent double mismatches at each position (except at the 5'-most base which must remain a G for efficient expression from the U6 promoter). Data presented as in 5A.

Figure 6A:
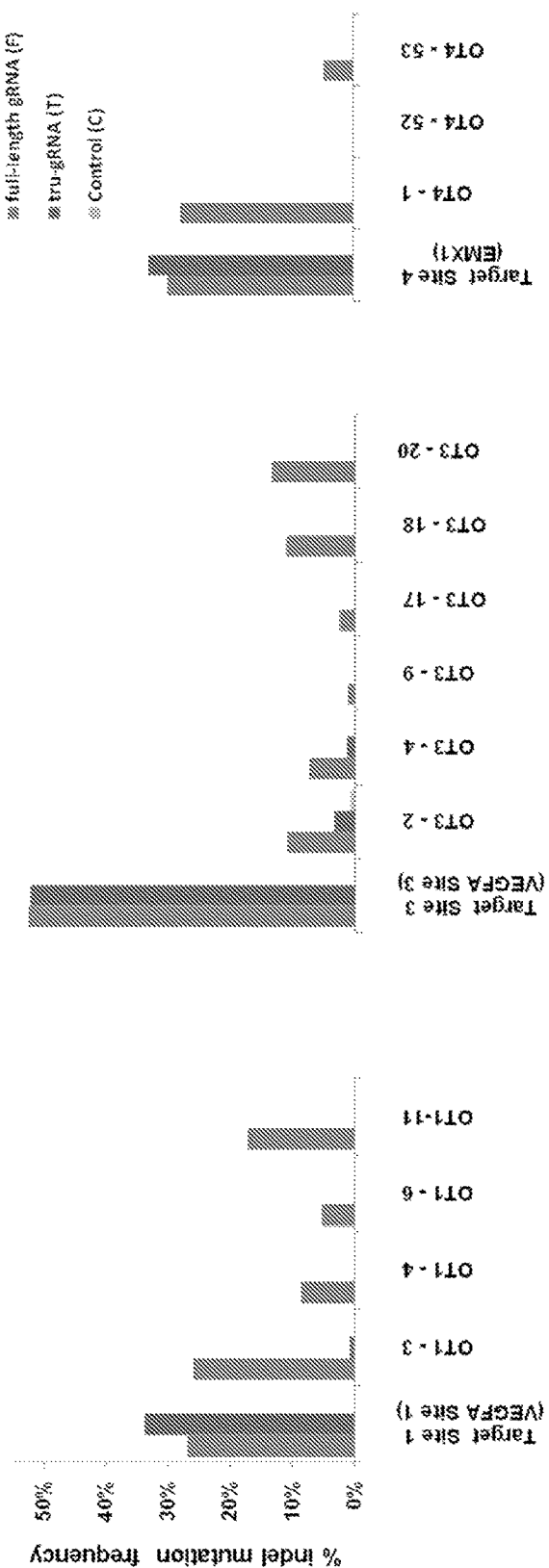

FIG. 6A: Absolute frequencies of on- and off-target indel mutations induced by RGNs targeted to three different endogenous human gene sites as measured by deep sequencing. Indel frequencies are shown for the three target sites from cells in which targeted RGNs with a full-length gRNA, a tru-gRNA, or a control gRNA lacking a complementarity region were expressed. Absolute counts of indel mutations used to make these graphs can be found in Table 3B.

FIG. 6B: Fold-improvements in off-target site specificities of three tru-RGNs. Values shown represent the ratio of on/off-target activities of tru-RGNs to on/off-target activities of standard RGNs for the off-target sites shown, calculated using the data from (A) and Table 3B. For the sites marked with an asterisk (*), no indels were observed with the tru-RGN and therefore the values shown represent conservative statistical estimates for the fold-improvements in specificities for these off-target sites (see Results and Experimental Procedures).

FIG. 6C, top: Comparison of the on-target and an off-target site identified by T7EI assay for the tru-RGN targeted to VEGFA site 1 (more were identified by deep sequencing). Note that the full-length gRNA is mismatched to the two nucleotides at the 5' end of the target site and that these are the two nucleotides not present in the tru-gRNA target site. Mismatches in the off-target site relative to the on-target are highlighted in bold underlined text. Mismatches between the gRNAs and the off-target site are shown with X's.

FIG. 6C, bottom: Indel mutation frequencies induced in the off-target site by RGNs bearing full-length or truncated gRNAs. Indel mutation frequencies were determined by T7EI assay. Note that the off-target site in this figure is one that we had examined previously for indel mutations induced by the standard RGN targeted to VEGFA site 1 and designated as site OT1-30 in that earlier study (Example 1 and Fu et al., Nat Biotechnol. 31(9):822-6 (2013)). It is likely that we did not identify off-target mutations at this site in our previous experiments because the frequency of indel mutations appears to be at the reliable detection limit of the T7EI assay (2-5%).

FIGS. 7A-D: DNA sequences of indel mutations induced by RGNs using tru-gRNAs or matched full-length gRNAs targeted to VEGFA sites 1 and 3. Sequences depicted as in FIG. 3C.

Figure 7E:
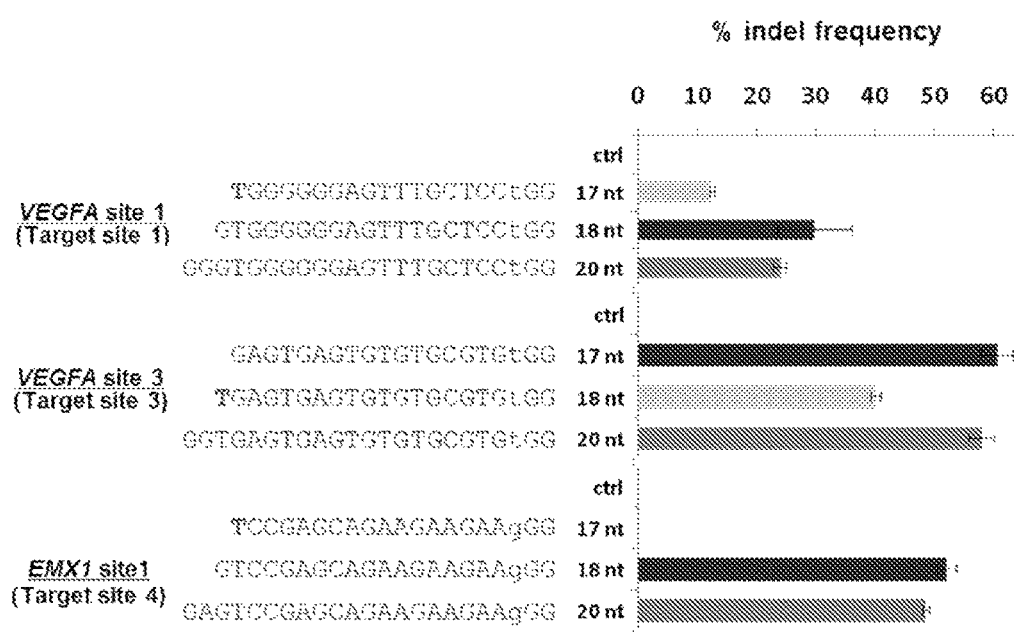

FIG. 7E. Indel mutation frequencies induced by tru-gRNAs bearing a mismatched 5' G nucleotide. Indel mutation frequencies in human U2OS.EGFP cells induced by Cas9 directed by tru-gRNAs bearing 17, 18 or 20 nt complementarity regions for VEGFA sites 1 and 3 and EMX1 site 1 are shown. Three of these gRNAs contain a mismatched 5' G (indicated by positions marked in bold text). Bars indicate results from experiments using full-length gRNA (20 nt), tru-gRNA (17 or 18 nt), and tru-gRNA with a mismatched 5' G nucleotide (17 or 18 nt with boldface T at 5' end). (Note that no activity was detectable for the mismatched tru-gRNA to EMX1 site 1.)

FIGS. 8A-C: Sequences of off-target indel mutations induced by RGNs in human U2OS.EGFP cells. Wild-type genomic off-target sites recognized by RGNs (including the PAM sequence) are highlighted in grey and numbered as in Table 1 and Table B. Note that the complementary strand is shown for some sites. Deleted bases are shown as dashes on a grey background. Inserted bases are italicized and highlighted in grey.

FIGS. 9A-C: Sequences of off-target indel mutations induced by RGNs in human HEK293 cells. Wild-type genomic off-target sites recognized by RGNs (including the PAM sequence) are highlighted in grey and numbered as in Table 1 and Table B. Note that the complementary strand is shown for some sites. Deleted bases are shown as dashes on a grey background. Inserted bases are italicized and highlighted in grey. *Yielded a large number of single by indels.

DETAILED DESCRIPTION

CRISPR RNA-guided nucleases (RGNs) have rapidly emerged as a facile and efficient platform for genome editing. Although Marraffini and colleagues (Jiang et al., Nat Biotechnol 31, 233-239 (2013)) recently performed a systematic investigation of Cas9 RGN specificity in bacteria, the specificities of RGNs in human cells have not been extensively defined. Understanding the scope of RGN-mediated off-target effects in human and other eukaryotic cells will be critically essential if these nucleases are to be used widely for research and therapeutic applications. The present inventors have used a human cell-based reporter assay to characterize off-target cleavage of Cas9-based RGNs. Single and double mismatches were tolerated to varying degrees depending on their position along the guide RNA (gRNA)-DNA interface. Off-target alterations induced by four out of six RGNs targeted to endogenous loci in human cells were readily detected by examination of partially mismatched sites. The off-target sites identified harbor up to five mismatches and many are mutagenized with frequencies comparable to (or higher than) those observed at the intended on-target site. Thus RGNs are highly active even with imperfectly matched RNA-DNA interfaces in human cells, a finding that might confound their use in research and therapeutic applications.

The results described herein reveal that predicting the specificity profile of any given RGN is neither simple nor straightforward. The EGFP reporter assay experiments show that single and double mismatches can have variable effects on RGN activity in human cells that do not strictly depend upon their position(s) within the target site. For example, consistent with previously published reports, alterations in the 3' half of the sgRNA/DNA interface generally have greater effects than those in the 5' half (Jiang et al., Nat Biotechnol 31, 233-239 (2013); Cong et al., Science 339, 819-823 (2013); Jinek et al., Science 337, 816-821 (2012)); however, single and double mutations in the 3' end sometimes also appear to be well tolerated whereas double mutations in the 5' end can greatly diminish activities. In addition, the magnitude of these effects for mismatches at any given position(s) appears to be site-dependent. Comprehensive profiling of a large series of RGNs with testing of all possible nucleotide substitutions (beyond the Watson- Crick transversions used in our EGFP reporter experiments) may help provide additional insights into the range of potential off-targets. In this regard, the recently described bacterial cell-based method of Marraffini and colleagues (Jiang et al., Nat Biotechnol 31, 233-239 (2013)) or the in vitro, combinatorial library-based cleavage site-selection methodologies previously applied to ZFNs by Liu and colleagues (Pattanayak et al., Nat Methods 8, 765-770 (2011)) might be useful for generating larger sets of RGN specificity profiles.

Despite these challenges in comprehensively predicting RGN specificities, it was possible to identify bona fide off-targets of RGNs by examining a subset of genomic sites that differed from the on-target site by one to five mismatches. Notably, under conditions of these experiments, the frequencies of RGN-induced mutations at many of these off-target sites were similar to (or higher than) those observed at the intended on-target site, enabling the detection of mutations at these sites using the T7EI assay (which, as performed in our laboratory, has a reliable detection limit of ~2 to 5% mutation frequency). Because these mutation rates were very high, it was possible to avoid using deep sequencing methods previously required to detect much lower frequency ZFN- and TALEN-induced off-target alterations (Pattanayak et al., Nat Methods 8, 765-770 (2011); Perez et al., Nat Biotechnol 26, 808-816 (2008); Gabriel et al., Nat Biotechnol 29, 816-823 (2011); Hockemeyer et al., Nat Biotechnol 29, 731-734 (2011)). Analysis of RGN off-target mutagenesis in human cells also confirmed the difficulties of predicting RGN specificities—not all single and double mismatched off-target sites show evidence of mutation whereas some sites with as many as five mismatches can also show alterations. Furthermore, the bona fide off-target sites identified do not exhibit any obvious bias toward transition or transversion differences relative to the intended target sequence (Table E; grey highlighted rows).

Although off-target sites were seen for a number of RGNs, identification of these sites was neither comprehensive nor genome-wide in scale. For the six RGNs studied, only a very small subset of the much larger total number of potential off-target sequences in the human genome (sites that differ by three to six nucleotides from the intended target site; compare Tables E and C) was examined. Although examining such large numbers of loci for off-target mutations by T7EI assay is neither a practical nor a cost-effective strategy, the use of high-throughput sequencing in future studies might enable the interrogation of larger numbers of candidate off-target sites and provide a more sensitive method for detecting bona fide off-target mutations. For example, such an approach might enable the unveiling of additional off-target sites for the two RGNs for which we failed to uncover any off-target mutations. In addition, an improved understanding both of RGN specificities and of any epigenomic factors (e.g., DNA methylation and chromatin status) that may influence RGN activities in cells might also reduce the number of potential sites that need to be examined and thereby make genome-wide assessments of RGN off-targets more practical and affordable.

As described herein, a number of strategies can be used to minimize the frequencies of genomic off-target mutations. For example, the specific choice of RGN target site can be optimized; given that off-target sites that differ at up to five positions from the intended target site can be efficiently mutated by RGNs, choosing target sites with minimal numbers of off-target sites as judged by mismatch counting seems unlikely to be effective; thousands of potential off-target sites that differ by four or five positions within the 20 bp RNA:DNA complementarity region will typically exist for any given RGN targeted to a sequence in the human genome (see, for example, Table C). It is also possible that the nucleotide content of the gRNA complementarity region might influence the range of potential off-target effects. For example, high GC-content has been shown to stabilize RNA:DNA hybrids (Sugimoto et al., Biochemistry 34, 11211-11216 (1995)) and therefore might also be expected to make gRNA/genomic DNA hybridization more stable and more tolerant to mismatches. Additional experiments with larger numbers of gRNAs will be needed to assess if and how these two parameters (numbers of mismatched sites in the genome and stability of the RNA:DNA hybrid) influence the genome-wide specificities of RGNs. However, it is important to note that even if such predictive parameters can be defined, the effect of implementing such guidelines would be to further restrict the targeting range of RGNs.

One potential general strategy for reducing RGN-induced off-target effects might be to reduce the concentrations of gRNA and Cas9 nuclease expressed in the cell. This idea was tested using the RGNs for VEGFA target sites 2 and 3 in U2OS.EGFP cells; transfecting less sgRNA- and Cas9-expressing plasmid decreased the mutation rate at the on-target site but did not appreciably change the relative rates of off-target mutations (Tables 2A and 2B). Consistent with this, high-level off-target mutagenesis rates were also observed in two other human cell types (HEK293 and K562 cells) even though the absolute rates of on-target mutagenesis are lower than in U2OS.EGFP cells. Thus, reducing expression levels of gRNA and Cas9 in cells is not likely to provide a solution for reducing off-target effects. Furthermore, these results also suggest that the high rates of off-target mutagenesis observed in human cells are not caused by overexpression of gRNA and/or Cas9.

TABLE 2A

Indel mutation frequencies at on- and off-target genomic sites induced by different amounts of Cas9- and single gRNA-expressing plasmids for the RGN targeted to VEGFA Target Site 2

| Site | Sequence | SEQ ID NO: | 250 ng gRNA/750 ng Cas9 Mean indel frequency (%) ± SEM | 12.5 ng gRNA/50 ng Cas9 Mean indel frequency (%) ± SEM |
| --- | --- | --- | --- | --- |
| T2 (On-target) | GACCCCCTCCACCCCGCCTCCGG | 12 | 50.2 ± 4.9 | 25.4 ± 4.8 |
| OT2-1 | GACCCCCcCCACCCCGCCcCCGG | 13 | 14.4 ± 3.4 | 4.2 ± 0.2 |
| OT2-2 | GggCCCCTCCACCCCGCCTCTGG | 14 | 20.0 ± 6.2 | 9.8 ± 1.1 |

TABLE 2A-continued

Indel mutation frequencies at on- and off-target genomic sites induced by different amounts of Cas9- and single gRNA-expressing plasmids for the RGN targeted to VEGFA Target Site 2

| Site | Sequence | SEQ ID NO: | 250 ng gRNA/750 ng Cas9 Mean indel frequency (%) ± SEM | 12.5 ng gRNA/50 ng Cas9 Mean indel frequency (%) ± SEM |
|---|---|---|---|---|
| OT2-6  | CTACCCCTCCACCCCGCCTCCGG | 15 | 8.2 ± 1.4  | 6.0 ± 0.5 |
| OT2-9  | GCCCCCACCCACCCCGCCTCTGG | 16 | 50.7 ± 5.6 | 16.4 ± 2.1 |
| OT2-15 | TACCCCCCACACCCCGCCTCTGG | 17 | 9.7 ± 4.5  | 2.1 ± 0.0 |
| OT2-17 | ACACCCCCCCACCCCGCCTCAGG | 18 | 14.0 ± 2.8 | 7.1 ± 0.0 |
| OT2-19 | ATTCCCCCCCACCCCGCCTCAGG | 19 | 17.0 ± 3.3 | 9.2 ± 0.4 |
| OT2-20 | CCCCACCCCCACCCCGCCTCAGG | 20 | 6.1 ± 1.3  | N.D. |
| OT2-23 | CGCCCTCCCCACCCCGCCTCCGG | 21 | 44.4 ± 6.7 | 35.1 ± 1.8 |
| OT2-24 | CTCCCCACCCACCCCGCCTCAGG | 22 | 62.8 ± 5.0 | 44.1 ± 4.5 |
| OT2-29 | TGCCCCTCCCACCCCGCCTCTGG | 23 | 13.8 ± 5.2 | 5.0 ± 0.2 |
| OT2-34 | AGGCCCCCACACCCCGCCTCAGG | 24 | 2.8 ± 1.5  | N.D. |

Amounts of gRNA- and Cas9-expressing plasmids transfected into U2OS.EGFP cells for these assays are shown at the top of each column. (Note that data for 250 ng gRNA/750 ng Cas9 are the same as those presented in Table 1.) Mean indel frequencies were determined using the T7EI assay from replicate samples as described in Methods. OT = Off-target sites, numbered as in Table 1 and Table B. Mismatches from the on-target site (within the 20 bpregion to which the gRNA hybridizes) are highlighted as bold, underlined text. N.D. = none detected

TABLE 2B

Indel mutation frequencies at on- and off-target genomic sites induced by different amounts of Cas9- and single gRNA-expressing plasmids for the RGN targeted to VEGFA Target Site 3

| Site | Sequence | SEQ ID NO: | 250 ng gRNA/750 ng Cas9 Mean indel frequency (%) ± SEM | 12.5 ng gRNA/250 ng Cas9 Mean indel frequency (%) ± SEM |
|---|---|---|---|---|
| T3 (On-target) | GGTGAGTGAGTGTGTGCGTGTGG | 25 | 49.4 ± 3.8 | 33.0 ± 3.7 |
| OT3-1  | GGTGAGTGAGTGTGTGTGAGG | 26 | 7.4 ± 3.4  | N.D. |
| OT3-2  | AGTGAGTGAGTGTGTGTGGGG | 27 | 24.3 ± 9.2 | 9.8 ± 4.2 |
| OT3-4  | GCTGAGTGAGTGTATGCGTGTGG | 28 | 20.9 ± 11.8| 4.2 ± 1.2 |
| OT3-9  | GGTGAGTGAGTGCGTGCGGGTGG | 29 | 3.2 ± 0.3  | N.D. |
| OT3-17 | GTTGAGTGAATGTGTGCGTGAGG | 30 | 2.9 ± 0.2  | N.D. |
| OT3-18 | TGTGGGTGAGTGTGTGCGTGAGG | 31 | 13.4 ± 4.2 | 4.9 ± 0.0 |
| OT3-20 | AGAGAGTGAGTGTGTGCATGAGG | 32 | 16.7 ± 3.5 | 7.9 ± 2.4 |

Amounts of gRNA- and Cas9-expressing plasmids transfected into U2OS.EGFP cells for these assays are shown at the top of each column. (Note that data for 250 ng gRNA/750 ng Cas9 are the same as those presented in Table 1.) Mean indel frequencies were determined using the T7EI assay from replicate samples as described in Methods. OT = Off-target sites, numbered as in Table 1 and Table B. N.D. = none detected The finding that significant off-target mutagenesis can be induced by RGNs in three different human cell types has important implications for broader use of this genome-editing platform. For research applications, the potentially confounding effects of high frequency off-target mutations will need to be considered, particularly for experiments involving either cultured cells or organisms with slow generation times for which the outcrossing of undesired alterations would be challenging. One way to control for such effects might be to utilize multiple RGNs targeted to different DNA sequences to induce the same genomic alteration because off-target effects are not random but instead related to the targeted site. However, for therapeutic applications, these findings clearly indicate that the specificities of RGNs will need to be carefully defined and/or improved if these nucleases are to be used safely in the longer term for treatment of human diseases.

Methods for Improving Specificity

As shown herein, CRISPR-Cas RNA-guided nucleases based on the S. pyogenes Cas9 protein can have significant off-target mutagenic effects that are comparable to or higher than the intended on-target activity (Example 1). Such off-target effects can be problematic for research and in particular for potential therapeutic applications. Therefore, methods for improving the specificity of CRISPR-Cas RNA guided nucleases (RGNs) are needed.

As described in Example 1, Cas9 RGNs can induce high-frequency indel mutations at off-target sites in human cells (see also Cradick et al., 2013; Fu et al., 2013; Hsu et al., 2013; Pattanayak et al., 2013). These undesired alterations can occur at genomic sequences that differ by as many as five mismatches from the intended on-target site (see Example 1). In addition, although mismatches at the 5' end of the gRNA complementarity region are generally better tolerated than those at the 3' end, these associations are not absolute and show site-to-site-dependence (see Example 1 and Fu et al., 2013; Hsu et al., 2013; Pattanayak et al., 2013). As a result, computational methods that rely on the number and/or positions of mismatches currently have limited predictive value for identifying bona fide off-target sites. Therefore, methods for reducing the frequencies of off-target mutations remain an important priority if RNA-guided nucleases are to be used for research and therapeutic applications.

Truncated Guide RNAs (Tru-gRNAs) Achieve Greater Specificity

Guide RNAs generally speaking come in two different systems: System 1, which uses separate crRNA and tracrRNAs that function together to guide cleavage by Cas9, and System 2, which uses a chimeric crRNA-tracrRNA hybrid that combines the two separate guide RNAs in a single system (referred to as a single guide RNA or sgRNA, see also Jinek et al., Science 2012; 337:816-821). The tracrRNA can be variably truncated and a range of lengths has been shown to function in both the separate system (system 1) and the chimeric gRNA system (system 2). For example, in some embodiments, tracrRNA may be truncated from its 3' end by at least 1, 2, 3, 4, 5, 6, 7, 8, 9, 10, 15, 20, 25, 30, 35 or 40 nts. In some embodiments, the tracrRNA molecule may be truncated from its 5' end by at least 1, 2, 3, 4, 5, 6, 7, 8, 9, 10, 15, 20, 25, 30, 35 or 40 nts. Alternatively, the tracrRNA molecule may be truncated from both the 5' and 3' end, e.g., by at least 1, 2, 3, 4, 5, 6, 7, 8, 9, 10, 15 or 20 nts on the 5' end and at least 1, 2, 3, 4, 5, 6, 7, 8, 9, 10, 15, 20, 25, 30, 35 or 40 nts on the 3' end. See, e.g., Jinek et al., Science 2012; 337:816-821; Mali et al., Science. 2013 Feb. 15; 339(6121):823-6; Cong et al., Science. 2013 Feb. 15; 339 (6121):819-23; and Hwang and Fu et al., Nat Biotechnol. 2013 March; 31(3):227-9; Jinek et al., Elife 2, e00471 (2013)). For System 2, generally the longer length chimeric gRNAs have shown greater on-target activity but the relative specificities of the various length gRNAs currently remain undefined and therefore it may be desirable in certain instances to use shorter gRNAs. In some embodiments, the gRNAs are complementary to a region that is within about 100-800 bp upstream of the transcription start site, e.g., is within about 500 bp upstream of the transcription start site, includes the transcription start site, or within about 100-800 bp, e.g., within about 500 bp, downstream of the transcription start site. In some embodiments, vectors (e.g., plasmids) encoding more than one gRNA are used, e.g., plasmids encoding, 2, 3, 4, 5, or more gRNAs directed to different sites in the same region of the target gene.

The present application describes a strategy for improving RGN specificity based on the seemingly counterintuitive idea of shortening, rather than lengthening, the gRNA complementarity region. These shorter gRNAs can induce various types of Cas9-mediated on-target genome editing events with efficiencies comparable to (or, in some cases, higher than) full-length gRNAs at multiple sites in a single integrated EGFP reporter gene and in endogenous human genes. In addition, RGNs using these shortened gRNAs exhibit increased sensitivity to small numbers of mismatches at the gRNA-target DNA interface. Most importantly, use of shortened gRNAs substantially reduces the rates of genomic off-target effects in human cells, yielding improvements of specificity as high as 5000-fold or more at these sites. Thus, this shortened gRNA strategy provides a highly effective approach for reducing off-target effects without compromising on-target activity and without the need for expression of a second, potentially mutagenic gRNA. This approach can be implemented on its own or in conjunction with other strategies such as the paired nickase method to reduce the off-target effects of RGNs in human cells.

Figure 1:
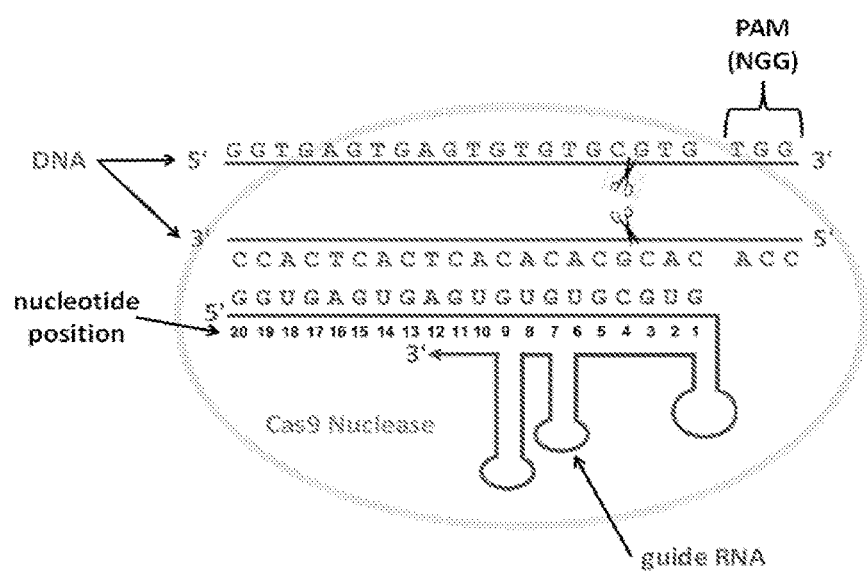
FIG. 1: Schematic illustrating a gRNA/Cas9 nuclease complex bound to its target DNA site. Scissors indicate approximate cleavage points of the Cas9 nuclease on the genomic DNA target site. Note the numbering of nucleotides on the guide RNA proceeds in an inverse fashion from 5' to 3'.

Thus, one method to enhance specificity of CRISPR/Cas nucleases shortens the length of the guide RNA (gRNA) species used to direct nuclease specificity. Cas9 nuclease can be guided to specific 17-18 nt genomic targets bearing an additional proximal protospacer adjacent motif (PAM), e.g., of sequence NGG, using a guide RNA, e.g., a single gRNA or a crRNA (paired with a tracrRNA), bearing 17 or 18 nts at its 5' end that are complementary to the complementary strand of the genomic DNA target site (FIG. 1).

Although one might expect that increasing the length of the gRNA complementarity region would improve specificity, the present inventors (Hwang et al., PLoS One. 2013 Jul. 9; 8 (7):e68708) and others (Ran et al., Cell. 2013 Sep. 12; 154(6):1380-9) have previously observed that lengthening the target site complementarity region at the 5' end of the gRNA actually makes it function less efficiently at the on-target site.

By contrast, experiments in Example 1 showed that gRNAs bearing multiple mismatches within a standard length 5' complementarity targeting region could still induce robust Cas9-mediated cleavage of their target sites. Thus, it was possible that truncated gRNAs lacking these 5'-end nucleotides might show activities comparable to their full-length counterparts (FIG. 2A). It was further speculated that these 5' nucleotides might normally compensate for mismatches at other positions along the gRNA-target DNA interface and therefore predicted that shorter gRNAs might be more sensitive to mismatches and thus induce lower levels of off-target mutations (FIG. 2A).

Decreasing the length of the DNA sequence targeted might also decrease the stability of the gRNA:DNA hybrid, making it less tolerant of mismatches and thereby making the targeting more specific. That is, truncating the gRNA sequence to recognize a shorter DNA target might actually result in a RNA-guided nuclease that is less tolerant to even single nucleotide mismatches and is therefore more specific and has fewer unintended off-target effects.

This strategy for shortening the gRNA complementarity region could potentially be used with RNA guided proteins other than S. pyogenes Cas9 including other Cas proteins from bacteria or archaea as well as Cas9 variants that nick a single strand of DNA or have no-nuclease activity such as a dCas9 bearing catalytic inactivating mutations in one or both nuclease domains. This strategy can be applied to systems that utilize a single gRNA as well as those that use dual gRNAs (e.g., the crRNA and tracrRNA found in naturally occurring systems).

Thus, described herein is a single guide RNA comprising a crRNA fused to a normally trans-encoded tracrRNA, e.g., a single Cas9 guide RNA as described in Mali et al., Science 2013 Feb. 15; 339(6121):823-6, but with a sequence at the 5' end that is complementary to fewer than 20 nucleotides (nts), e.g., 19, 18, or 17 nts, preferably 17 or 18 nts, of the complementary strand to a target sequence immediately 5' of a protospacer adjacent motif (PAM), e.g., NGG, NAG, or NNGG. In some embodiments, the shortened Cas9 guide RNA consists of the sequence:

(SEQ ID NO: 2404)
$(X_{17-18}$ or $X_{17-19})$GUUUUAGAGCUA;

(SEQ ID NO: 2407)
$(X_{17-18}$ or $X_{17-19})$GUUUUAGAGCUAUGCUGUUUUG;
or (SEQ ID NO: 2408)
$(X_{17-18}$ or $X_{17-19})$GUUUUAGAGCUAUGCU;

(SEQ ID NO: 1)
$(X_{17-18}$ or $X_{17-19})$GUUUUAGAGCUAGAAAUAGCAAGUUAAAAUAA

GGCUAGUCCG$(X_N)$;

(SEQ ID NO: 2)
$(X_{17-18}$ or $X_{17-19})$GUUUUAGAGCUAUGCUGAAAAGCAUAGCAAGU

UAAAAUAAGGCUAGUCCGUUAUC$(X_N)$;

(SEQ ID NO: 3)
$(X_{17-18}$ or $X_{17-19})$GUUUUAGAGCUAUGCUGUUUUGGAAACAAAAC

AGCAUAGCAAGUUAAAAUAAGGCUAGUCCGUUAUC$(X_N)$;

(SEQ ID NO: 4)
$(X_{17-18}$ or $X_{17-19})$GUUUUAGAGCUAGAAAUAGCAAGUUAAAAUAA

GGCUAGUCCGUUAUCAACUUGAAAAAGUGGCACCGAGUCGGUGC$(X_N)$, (SEQ ID NO: 5)
$(X_{17-18}$ or $X_{17-19})$GUUUAAGAGCUAGAAAUAGCAAGUUUAAAUAA

GGCUAGUCCGUUAUCAACUUGAAAAAGUGGCACCGAGUCGGUGC;

(SEQ ID NO: 6)
$(X_{17-18}$ or $X_{17-19})$GUUUUAGAGCUAUGCUGGAAACAGCAUAGCAA

GUUUAAAUAAGGCUAGUCCGUUAUCAACUUGAAAAAGUGGCACCGAGUCG

GUGC;
or (SEQ ID NO: 7)
$(X_{17-18}$ or $X_{17-19})$GUUUAAGAGCUAUGCUGGAAACAGCAUAGCAA

GUUUAAAUAAGGCUAGUCCGUUAUCAACUUGAAAAAGUGGCACCGAGUCG

GUGC;

wherein $X_{17-18}$ or $X_{17-19}$ is the nucleotide sequence complementary to 17-18 or 17-19 consecutive nucleotides of the target sequence, respectively. Also described herein are DNAs encoding the shortened Cas9 guide RNAs that have been described previously in the literature (Jinek et al., Science. 337(6096):816-21 (2012) and Jinek et al., Elife. 2:e00471 (2013)).

The guide RNAs can include $X_N$ which can be any sequence, wherein N (in the RNA) can be 0-200, e.g., 0-100, 0-50, or 0-20, that does not interfere with the binding of the ribonucleic acid to Cas9.

In some embodiments, the guide RNA includes one or more Adenine (A) or Uracil (U) nucleotides on the 3' end. In some embodiments the RNA includes one or more U, e.g., 1 to 8 or more Us (e.g., U, UU, UUU, UUUU, UUUUU, UUUUUU, UUUUUUU) at the 3' end of the molecule, as a result of the optional presence of one or more Ts used as a termination signal to terminate RNA PolIII transcription.

Modified RNA oligonucleotides such as locked nucleic acids (LNAs) have been demonstrated to increase the specificity of RNA-DNA hybridization by locking the modified oligonucleotides in a more favorable (stable) conformation. For example, 2'-O-methyl RNA is a modified base where there is an additional covalent linkage between the 2' oxygen and 4' carbon which when incorporated into oligonucleotides can improve overall thermal stability and selectivity (formula I).

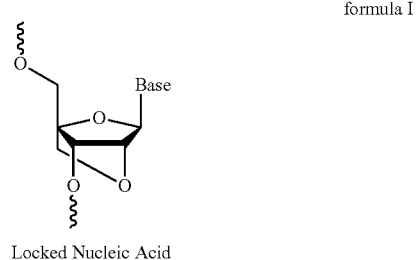

formula I

Locked Nucleic Acid

Thus in some embodiments, the tru-gRNAs disclosed herein may comprise one or more modified RNA oligonucleotides. For example, the truncated guide RNAs molecules described herein can have one, some or all of the 17-18 or 17-19 nts 5' region of the guide RNA complementary to the target sequence are modified, e.g., locked (2'-O-4'-C methylene bridge), 5'-methylcytidine, 2'-O-methyl-pseudouridine, or in which the ribose phosphate backbone has been replaced by a polyamide chain (peptide nucleic acid), e.g., a synthetic ribonucleic acid.

In other embodiments, one, some or all of the nucleotides of the tru-gRNA sequence may be modified, e.g., locked (2'-O-4'-C methylene bridge), 5'-methylcytidine, 2'-O-methyl-pseudouridine, or in which the ribose phosphate backbone has been replaced by a polyamide chain (peptide nucleic acid), e.g., a synthetic ribonucleic acid.

In a cellular context, complexes of Cas9 with these synthetic gRNAs could be used to improve the genome-wide specificity of the CRISPR/Cas9 nuclease system.

Exemplary modified or synthetic tru-gRNAs may comprise, or consist of, the following sequences:

(SEQ ID NO: 2404)
$(X_{17-18}$ or $X_{17-19})$GUUUUAGAGCUA$(X_N)$;

(SEQ ID NO: 2407)
$(X_{17-18}$ or $X_{17-19})$GUUUUAGAGCUAUGCUGUUUUG $(X_N)$;

(SEQ ID NO: 2408)
$(X_{17-18}$ or $X_{17-19})$GUUUUAGAGCUAUGCU$(X_N)$;

(SEQ ID NO: 1)
$(X_{17-18}$ or $X_{17-19})$GUUUUAGAGCUAGAAAUAGCAAGUUAAAAUAA

GGCUAGUCCG$(X_N)$;

-continued (X$_{17-18}$ or X$_{17-19}$)GUUUUAGAGCUAUGCUGAAAAGCAUAGCAAGU
UAAAAUAAGGCUAGUCCGUUAUC (X$_N$); (SEQ ID NO: 2)

(X$_{17-18}$ or X$_{17-19}$)GUUUUAGAGCUAUGCUGUUUUGGAAACAAAAC
AGCAUAGCAAGUUAAAAUAAGGCUAGUCCGUUAUC (X$_N$); (SEQ ID NO: 3)

(X$_{17-18}$)GUUUUAGAGCUAGAAAUAGCAAGUUAAAAUAAGGCUAGUCCG
UUAUCAACUUGAAAAAGUGGCACCGAGUCGGUGC (X$_N$), (SEQ ID NO: 4)

(X$_{17-18}$ or X$_{17-19}$)GUUUAAGAGCUAGAAAUAGCAAGUUUAAAUAA
GGCUAGUCCGUUAUCAACUUGAAAAAGUGGCACCGAGUCGGUGC; (SEQ ID NO: 5)

(X$_{17-18}$ or X$_{17-19}$)GUUUUAGAGCUAUGCUGGAAACAGCAUAGCAA
GUUUAAAUAAGGCUAGUCCGUUAUCAACUUGAAAAAGUGGCACCGAGUCG
GUGC; (SEQ ID NO: 6)

or (X$_{17-18}$ or X$_{17-19}$)GUUUAAGAGCUAUGCUGGAAACAGCAUAGCAA
GUUUAAAUAAGGCUAGUCCGUUAUCAACUUGAAAAAGUGGCACCGAGUCG
GUGC; (SEQ ID NO: 7)

wherein X$_{17-18}$ or X$_{17-19}$ is a sequence complementary to 17-18 or 17-19 nts of a target sequence, respectively, preferably a target sequence immediately 5' of a protospacer adjacent motif (PAM), e.g., NGG, NAG, or NNGG, and further wherein one or more of the nucleotides are locked, e.g., one or more of the nucleotides within the sequence X$_{17-18}$ or X$_{17-19}$, one or more of the nucleotides within the sequence X$_N$, or one or more of the nucleotides within any sequence of the tru-gRNA. X$_N$ is any sequence, wherein N (in the RNA) can be 0-200, e.g., 0-100, 0-50, or 0-20, that does not interfere with the binding of the ribonucleic acid to Cas9. In some embodiments the RNA includes one or more U, e.g., 1 to 8 or more Us (e.g., U, UU, UUU, UUUU, UUUUU, UUUUUU, UUUUUUU, UUUUUUUU) at the 3' end of the molecule, as a result of the optional presence of one or more Ts used as a termination signal to terminate RNA PolIII transcription.

Although some of the examples described herein utilize a single gRNA, the methods can also be used with dual gRNAs (e.g., the crRNA and tracrRNA found in naturally occurring systems). In this case, a single tracrRNA would be used in conjunction with multiple different crRNAs expressed using the present system, e.g., the following: (X$_{17-18}$ or X$_{17-19}$)GUUUUAGAGCUA (SEQ ID NO:2404); (X$_{17-18}$ or X$_{17-19}$) GUUUUAGAGCUAUGCUGUUUUG (SEQ ID NO:2407); or (X$_{17-18}$ or X$_{17-19}$)GUUUUAGAGC-UAUGCU (SEQ ID NO:2408); and a tracrRNA sequence. In this case, the crRNA is used as the guide RNA in the methods and molecules described herein, and the tracrRNA can be expressed from the same or a different DNA molecule. In some embodiments, the methods include contacting the cell with a tracrRNA comprising or consisting of the sequence GGAACCAUUCAAAACAGCAUAG-CAAGUUAAAAUAAGGCUAGUCCGUUA UCAAC-UUGAAAAAGUGGCACCGAGUCGGUGC (SEQ ID NO:8) or an active portion thereof (an active portion is one that retains the ability to form complexes with Cas9 or dCas9). In some embodiments, the tracrRNA molecule may be truncated from its 3' end by at least 1, 2, 3, 4, 5, 6, 7, 8, 9, 10, 15, 20, 25, 30, 35 or 40 nts. In another embodiment, the tracrRNA molecule may be truncated from its 5' end by at least 1, 2, 3, 4, 5, 6, 7, 8, 9, 10, 15, 20, 25, 30, 35 or 40 nts. Alternatively, the tracrRNA molecule may be truncated from both the 5' and 3' end, e.g., by at least 1, 2, 3, 4, 5, 6, 7, 8, 9, 10, 15 or 20 nts on the 5' end and at least 1, 2, 3, 4, 5, 6, 7, 8, 9, 10, 15, 20, 25, 30, 35 or 40 nts on the 3' end. Exemplary tracrRNA sequences in addition to SEQ ID NO:8 include the following:
UAGCAAGUUAAAAUAAGGCUAGUCCGUUAU-CAACUUGAAAAAGUGGCA CCGAGUCGGUGC (SEQ ID NO:2405) or an active portion thereof;
AGCAUAGCAAGUUAAAAUAAGGCUAGUC-CGUUAUCAACUUGAAAAAGU GGCACCGAGUCG-GUGC (SEQ ID NO:2407) or an active portion thereof;
CAAAACAGCAUAGCAAGUUAAAAUAAGGCUAGU-CCGUUAUCAACUUGA AAAGUGGCACCGAGUCG-GUGC (SEQ ID NO:2409) or an active portion thereof;
UAGCAAGUUAAAAUAAGGCUAGUCCGUUAU-CAACUUGAAAAAGUG (SEQ ID NO:2410) or an active portion thereof;
UAGCAAGUUAAAAUAAGGCUAGUCCGUUAUCA (SEQ ID NO:2411) or an active portion thereof; or UAG-CAAGUUAAAAUAAGGCUAGUCCG (SEQ ID NO:2412) or an active portion thereof.

In some embodiments wherein (X$_{17-18}$ or X$_{17-19}$) GUUUUAGAGCUAUGCUGUUUUG (SEQ ID NO:2407) is used as a crRNA, the following tracrRNA is used: GGAACCAUUCAAAACAGCAUAG-CAAGUUAAAAUAAGGCUAGUCCGUUA UCAAC-UUGAAAAAGUGGCACCGAGUCGGUGC (SEQ ID NO:8) or an active portion thereof. In some embodiments wherein (X$_{17-18}$ or X$_{17-19}$)GUUUUAGAGCUA (SEQ ID NO:2404) is used as a crRNA, the following tracrRNA is used: UAGCAAGUUAAAAUAAGGCUAGUC-CGUUAUCAACUUGAAAAAGUGGCA CCGAGUCG-GUGC (SEQ ID NO:2405) or an active portion thereof. In some embodiments wherein (X$_{17-18}$ or X$_{17-19}$) GUUUUA-GAGCUAUGCU (SEQ ID NO:2408) is used as a crRNA, the following tracrRNA is used: AGCAUAG-CAAGUUAAAAUAAGGCUAGUCCGUUAUCAAC-UUGAAAAAGU GGCACCGAGUCGGUGC (SEQ ID NO:2406) or an active portion thereof.

In addition, in a system that uses separate crRNA and tracrRNA, one or both can be synthetic and include one or more modified (e.g., locked) nucleotides or deoxyribonucleotides.

In some embodiments, the single guide RNAs and/or crRNAs and/or tracrRNAs can include one or more Adenine (A) or Uracil (U) nucleotides on the 3' end.

Existing Cas9-based RGNs use gRNA-DNA heteroduplex formation to guide targeting to genomic sites of interest. However, RNA-DNA heteroduplexes can form a more promiscuous range of structures than their DNA-DNA counterparts. In effect, DNA-DNA duplexes are more sensitive to mismatches, suggesting that a DNA-guided nuclease may not bind as readily to off-target sequences, making them comparatively more specific than RNA-guided nucleases. Thus, the truncated guide RNAs described herein can be hybrids, i.e., wherein one or more deoxyribonucleotides, e.g., a short DNA oligonucleotide, replaces all or part of the gRNA, e.g., all or part of the complementarity region of a gRNA. This DNA-based molecule could replace either all or part of the gRNA in a single gRNA system or alternatively might replace all of part of the crRNA in a dual crRNA/ tracrRNA system. Such a system that incorporates DNA into the complementarity region should more reliably target the intended genomic DNA sequences due to the general intolerance of DNA-DNA duplexes to mismatching compared to RNA-DNA duplexes. Methods for making such duplexes are known in the art, See, e.g., Barker et al., BMC Genomics. 2005 Apr. 22; 6:57; and Sugimoto et al., Biochemistry. 2000 Sep. 19; 39(37):11270-81.

Exemplary modified or synthetic tru-gRNAs may comprise, or consist of, the following sequences:

(SEQ ID NO: 1)
($X_{17-18}$ or $X_{17-19}$) GUUUUAGAGCUAGAAAUAGCAAGUUAAAAUAA

GGCUAGUCCG ($X_N$);

(SEQ ID NO: 2)
($X_{17-18}$ or $X_{17-19}$) GUUUUAGAGCUAUGCUGAAAAGCAUAGCAAGU

UAAAAUAAGGCUAGUCCGUUAUC ($X_N$);

(SEQ ID NO: 3)
($X_{17-18}$ or $X_{17-19}$) GUUUUAGAGCUAUGCUGUUUUGGAAACAAAAC

AGCAUAGCAAGUUAAAAUAAGGCUAGUCCGUUAUC ($X_N$);

(SEQ ID NO: 4)
($X_{17-18}$ or $X_{17-19}$) GUUUUAGAGCUAGAAAUAGCAAGUUAAAAUAA

GGCUAGUCCGUUAUCAACUUGAAAAAGUGGCACCGAGUCGGUGC ($X_N$), (SEQ ID NO: 5)
($X_{17-18}$ or $X_{17-19}$) GUUUAAGAGCUAGAAAUAGCAAGUUUAAAUAA

GGCUAGUCCGUUAUCAACUUGAAAAAGUGGCACCGAGUCGGUGC;

(SEQ ID NO: 6)
($X_{17-18}$ or $X_{17-19}$) GUUUUAGAGCUAUGCUGGAAACAGCAUAGCAA

GUUUAAAUAAGGCUAGUCCGUUAUCAACUUGAAAAAGUGGCACCGAGUCG

GUGC;
or (SEQ ID NO: 7)
($X_{17-18}$ or $X_{17-19}$) GUUUAAGAGCUAUGCUGGAAACAGCAUAGCAA

GUUUAAAUAAGGCUAGUCCGUUAUCAACUUGAAAAAGUGGCACCGAGUCG

GUGC;

wherein $X_{17-18}$ or $X_{17-19}$ is a sequence complementary to 17-18 or 17-19 nts of a target sequence, respectively, preferably a target sequence immediately 5' of a protospacer adjacent motif (PAM), e.g., NGG, NAG, or NNGG, and further wherein one or more of the nucleotides are deoxyribonucleotides, e.g., one or more of the nucleotides within the sequence $X_{17-18}$ or $X_{17-19}$, one or more of the nucleotides within the sequence $X_N$, or one or more of the nucleotides within any sequence of the tru-gRNA. $X_N$ is any sequence, wherein N (in the RNA) can be 0-200, e.g., 0-100, 0-50, or 0-20, that does not interfere with the binding of the ribonucleic acid to Cas9. In some embodiments the RNA includes one or more U, e.g., 1 to 8 or more Us (e.g., U, UU, UUU, UUUU, UUUUU, UUUUUU, UUUUUUU, UUUUUUUU) at the 3' end of the molecule, as a result of the optional presence of one or more Ts used as a termination signal to terminate RNA PolIII transcription.

In addition, in a system that uses separate crRNA and tracrRNA, one or both can be synthetic and include one or more deoxyribonucleotides.

In some embodiments, the single guide RNAs or crRNAs or tracrRNAs includes one or more Adenine (A) or Uracil (U) nucleotides on the 3' end.

In some embodiments, the gRNA is targeted to a site that is at least three or more mismatches different from any sequence in the rest of the genome in order to minimize off-target effects.

The methods described can include expressing in a cell, or contacting the cell with, a shortened Cas9 gRNA (tru-gRNA) as described herein (optionally a modified or DNA/RNA hybrid tru-gRNA), plus a nuclease that can be guided by the shortened Cas9 gRNAs, e.g., a Cas9 nuclease, e.g., as described in Mali et al., a Cas9 nickase as described in Jinek et al., 2012; or a dCas9-heterofunctional domain fusion (dCas9-HFD).

Cas9

A number of bacteria express Cas9 protein variants. The Cas9 from *Streptococcus pyogenes* is presently the most commonly used; some of the other Cas9 proteins have high levels of sequence identity with the *S. pyogenes* Cas9 and use the same guide RNAs. Others are more diverse, use different gRNAs, and recognize different PAM sequences as well (the 2-5 nucleotide sequence specified by the protein which is adjacent to the sequence specified by the RNA). Chylinski et al. classified Cas9 proteins from a large group of bacteria (RNA Biology 10:5, 1-12; 2013), and a large number of Cas9 proteins are listed in supplementary FIG. 1 and supplementary table 1 thereof, which are incorporated by reference herein. Additional Cas9 proteins are described in Esvelt et al., Nat Methods. 2013 November; 10(11):1116-21 and Fonfara et al., "Phylogeny of Cas9 determines functional exchangeability of dual-RNA and Cas9 among orthologous type II CRISPR-Cas systems." Nucleic Acids Res. 2013 Nov. 22. [Epub ahead of print] doi:10.1093/nar/gkt1074.

Cas9 molecules of a variety of species can be used in the methods and compositions described herein. While the *S. pyogenes* and *S. thermophilus* Cas9 molecules are the subject of much of the disclosure herein, Cas9 molecules of, derived from, or based on the Cas9 proteins of other species listed herein can be used as well. In other words, while the much of the description herein uses *S. pyogenes* and *S. thermophilus* Cas9 molecules, Cas9 molecules from the other species can replace them. Such species include those set forth in the following table, which was created based on supplementary FIG. 1 of Chylinski et al., 2013.

| Alternative Cas9 proteins | |
|---|---|
| GenBank Acc No. | Bacterium |
| 303229466 | *Veillonella atypica* ACS-134-V-Col7a |
| 34762592 | *Fusobacterium nucleatum* subsp. *vincentii* |
| 374307738 | *Filifactor alocis* ATCC 35896 |
| 320528778 | *Solobacterium moorei* F0204 |
| 291520705 | *Coprococcus catus* GD-7 |
| 42525843 | *Treponema denticola* ATCC 35405 |
| 304438954 | *Peptoniphilus duerdenii* ATCC BAA-1640 |
| 224543312 | *Catenibacterium mitsuokai* DSM 15897 |
| 24379809 | *Streptococcus mutans* UA159 |
| 15675041 | *Streptococcus pyogenes* SF370 |
| 16801805 | *Listeria innocua* Clip11262 |
| 116628213 | *Streptococcus thermophilus* LMD-9 |
| 323463801 | *Staphylococcus pseudintermedius* ED99 |
| 352684361 | *Acidaminococcus intestini* RyC-MR95 |
| 302336020 | *Olsenella uli* DSM 7084 |
| 366983953 | *Oenococcus kitaharae* DSM 17330 |
| 310286728 | *Bifidobacterium bifidum* S17 |
| 258509199 | *Lactobacillus rhamnosus* GG |
| 300361537 | *Lactobacillus gasseri* JV-V03 |
| 169823755 | *Finegoldia magna* ATCC 29328 |
| 47458868 | *Mycoplasma mobile* 163K |

Alternative Cas9 proteins

| GenBank Acc No. | Bacterium |
|---|---|
| 284931710 | *Mycoplasma gallisepticum* str. F |
| 363542550 | *Mycoplasma ovipneumoniae* SC01 |
| 384393286 | *Mycoplasma canis* PG 14 |
| 71894592 | *Mycoplasma synoviae* 53 |
| 238924075 | *Eubacterium rectale* ATCC 33656 |
| 116627542 | *Streptococcus thermophilus* LMD-9 |
| 315149830 | *Enterococcus faecalis* TX0012 |
| 315659848 | *Staphylococcus lugdunensis* M23590 |
| 160915782 | *Eubacterium dolichum* DSM 3991 |
| 336393381 | *Lactobacillus coryniformis* subsp. *torquens* |
| 310780384 | *Ilyobacter polytropus* DSM 2926 |
| 325677756 | *Ruminococcus albus* 8 |
| 187736489 | *Akkermansia muciniphila* ATCC BAA-835 |
| 117929158 | *Acidothermus cellulolyticus* 11B |
| 189440764 | *Bifidobacterium longum* DJO10A |
| 283456135 | *Bifidobacterium dentium* Bd1 |
| 38232678 | *Corynebacterium diphtheriae* NCTC 13129 |
| 187250660 | *Elusimicrobium minutum* Pei191 |
| 319957206 | *Nitratifractor salsuginis* DSM 16511 |
| 325972003 | *Sphaerochaeta globus* str. Buddy |
| 261414553 | *Fibrobacter succinogenes* subsp. *succinogenes* |
| 60683389 | *Bacteroides fragilis* NCTC 9343 |
| 256819408 | *Capnocytophaga ochracea* DSM 7271 |
| 90425961 | *Rhodopseudomonas palustris* BisB18 |
| 373501184 | *Prevotella micans* F0438 |
| 294674019 | *Prevotella ruminicola* 23 |
| 365959402 | *Flavobacterium columnare* ATCC 49512 |
| 312879015 | *Aminomonas paucivorans* DSM 12260 |
| 83591793 | *Rhodospirillum rubrum* ATCC 11170 |
| 294086111 | *Candidatus Puniceispirillum marinum* IMCC1322 |
| 121608211 | *Verminephrobacter eiseniae* EF01-2 |
| 344171927 | *Ralstonia syzygii* R24 |
| 159042956 | *Dinoroseobacter shibae* DFL 12 |
| 288957741 | *Azospirillum* sp- B510 |
| 92109262 | *Nitrobacter hamburgensis* X14 |
| 148255343 | *Bradyrhizobium* sp- BTAi1 |
| 34557790 | *Wolinella succinogenes* DSM 1740 |
| 218563121 | *Campylobacter jejuni* subsp. *jejuni* |
| 291276265 | *Helicobacter mustelae* 12198 |
| 229113166 | *Bacillus cereus* Rock1-15 |
| 222109285 | *Acidovorax ebreus* TPSY |
| 189485225 | uncultured Termite group 1 |
| 182624245 | *Clostridium perfringens* D str. |
| 220930482 | *Clostridium cellulolyticum* H10 |
| 154250555 | *Parvibaculum lavamentivorans* DS-1 |
| 257413184 | *Roseburia intestinalis* L1-82 |
| 218767588 | *Neisseria meningitidis* Z2491 |
| 15602992 | *Pasteurella multocida* subsp. *multocida* |
| 319941583 | *Sutterella wadsworthensis* 3 1 |
| 254447899 | gamma proteobacterium HTCC5015 |
| 54296138 | *Legionella pneumophila* str. Paris |
| 331001027 | *Parasutterella excrementihominis* YIT 11859 |
| 34557932 | *Wolinella succinogenes* DSM 1740 |
| 118497352 | *Francisella novicida* U112 |

The constructs and methods described herein can include the use of any of those Cas9 proteins, and their corresponding guide RNAs or other guide RNAs that are compatible. The Cas9 from *Streptococcus thermophilus* LMD-9 CRISPR1 system has also been shown to function in human cells in Cong et al (Science 339, 819 (2013)). Cas9 orthologs from *N. meningitides* are described in Hou et al., Proc Natl Acad Sci USA. 2013 Sep. 24; 110(39):15644-9 and Esvelt et al., Nat Methods. 2013 November; 10(11):1116-21. Additionally, Jinek et al. showed in vitro that Cas9 orthologs from *S. thermophilus* and *L. innocua*, (but not from *N. meningitidis* or *C. jejuni*, which likely use a different guide RNA), can be guided by a dual *S. pyogenes* gRNA to cleave target plasmid DNA, albeit with slightly decreased efficiency.

In some embodiments, the present system utilizes the Cas9 protein from *S. pyogenes*, either as encoded in bacteria or codon-optimized for expression in mammalian cells, containing mutations at D10, E762, H983, or D986 and H840 or N863, e.g., D10A/D10N and H840A/H840N/ H840Y, to render the nuclease portion of the protein catalytically inactive; substitutions at these positions could be alanine (as they are in Nishimasu al., Cell 156, 935-949 (2014)) or they could be other residues, e.g., glutamine, asparagine, tyrosine, serine, or aspartate, e.g., E762Q, H983N, H983Y, D986N, N863D, N863S, or N863H (FIG. 1C). The sequence of the catalytically inactive *S. pyogenes* Cas9 that can be used in the methods and compositions described herein is as follows; the exemplary mutations of D1 OA and H840A are in bold and underlined.

```
               10         20         30         40
       MDKKYSIGLA IGTNSVGWAV ITDEYKVPSK KFKVLGNTDR 50         60         70         80
       HSIKKNLIGA LLFDSGETAE ATRLKRTARR RYTRRKNRIC 90        100        110        120
       YLQEIFSNEM AKVDDSFFHR LEESFLVEED KKHERHPIFG 130        140        150        160
       NIVDEVAYHE KYPTIYHLRK KLVDSTDKAD LRLIYLALAH 170        180        190        200
       MIKFRGHFLI EGDLNPDNSD VDKLFIQLVQ TYNQLFEENP 210        220        230        240
       INASGVDAKA ILSARLSKSR RLENLIAQLP GEKKNGLFGN 250        260        270        280
       LIALSLGLTP NFKSNFDLAE DAKLQLSKDT YDDDLDNLLA 290        300        310        320
       QIGDQYADLF LAAKNLSDAI LLSDILRVNT EITKAPLSAS 330        340        350        360
       MIKRYDEHHQ DLTLLKALVR QQLPEKYKEI FFDQSKNGYA 370        380        390        400
       GYIDGGASQE EFYKFIKPIL EKMDGTEELL VKLNREDLLR 410        420        430        440
       KQRTFDNGSI PHQIHLGELH AILRRQEDFY PFLKDNREKI 450        460        470        480
       EKILTFRIPY YVGPLARGNS RFAWMTRKSE ETITPWNFEE 490        500        510        520
       VVDKGASAQS FIERMTNFDK NLPNEKVLPK HSLLYEYFTV 530        540        550        560
       YNELTKVKYV TEGMRKPAFL SGEQKKAIVD LLFKTNRKVT 570        580        590        600
       VKQLKEDYFK KIECFDSVEI SGVEDRFNAS LGTYHDLLKI 610        620        630        640
       IKDKDFLDNE ENEDILEDIV LTLTLFEDRE MIEERLKTYA 650        660        670        680
       HLFDDKVMKQ LKRRRYTGWG RLSRKLINGI RDKQSGKTIL 690        700        710        720
       DFLKSDGFAN RNFMQLIHDD SLTFKEDIQK AQVSGQGDSL 730        740        750        760
       HEHIANLAGS PAIKKGILQT VKVVDELVKV MGRHKPENIV 770        780        790        800
       IEMARENQTT QKGQKNSRER MKRIEEGIKE LGSQILKEHP 810        820        830        840
       VENTQLQNEK LYLYYLQNGR DMYVDQELDI NRLSDYDVDA
```

```
                 -continued
        850        860        870        880
   IVPQSFLKDD SIDNKVLTRS DKNRGKSDNV PSEEVVKKMK 890        900        910        920
   NYWRQLLNAK LITQRKFDNL TKAERGGLSE LDKAGFIKRQ 930        940        950        960
   LVETRQITKH VAQILDSRMN TKYDENDKLI REVKVITLKS 970        980        990       1000
   KLVSDFRKDF QFYKVREINN YHHAHDAYLN AVVGTALIKK 1010       1020       1030       1040
   YPKLESEFVY GDYKVYDVRK MIAKSEQEIG KATAKYFFYS 1050       1060       1070       1080
   NIMNFFKTEI TLANGEIRKR PLIETNGETG EIVWDKGRDF 1090       1100       1110       1120
   ATVRKVLSMP QVNIVKKTEV QTGGFSKESI LPKRNSDKLI 1130       1140       1150       1160
   ARKKDWDPKK YGGFDSPTVA YSVLVVAKVE KGKSKKLKSV 1170       1180       1190       1200
   KELLGITIME RSSFEKNPID FLEAKGYKEV KKDLIIKLPK 1210       1220       1230       1240
   YSLFELENGR KRMLASAGEL QKGNELALPS KYVNFLYLAS 1250       1260       1270       1280
   HYEKLKGSPE DNEQKQLFVE QHKHYLDEII EQISEFSKRV 1290       1300       1310       1320
   ILADANLDKV LSAYNKHRDK PIREQAENII HLFTLTNLGA 1330       1340       1350       1360
   PAAFKYFDTT IDRKRYTSTK EVLDATLIHQ SITGLYETRI

DLSQLGGD (SEQ ID NO: 33)
```

In some embodiments, the Cas9 nuclease used herein is at least about 50% identical to the sequence of *S. pyogenes* Cas9, i.e., at least 50% identical to SEQ ID NO:33. In some embodiments, the nucleotide sequences are about 50%, 55%, 60%, 65%, 70%, 75%, 80%, 85%, 90%, 95%, 99% or 100% identical to SEQ ID NO:33. In some embodiments, any differences from SEQ ID NO:33 are in non-conserved regions, as identified by sequence alignment of sequences set forth in Chylinski et al., RNA Biology 10:5, 1-12; 2013 (e.g., in supplementary FIG. 1 and supplementary table 1 thereof); Esvelt et al., Nat Methods. 2013 November; 10(11):1116-21 and Fonfara et al., Nucl. Acids Res. (2014) 42 (4): 2577-2590. [Epub ahead of print 2013 Nov. 22] doi:10.1093/nar/gkt1074.

To determine the percent identity of two sequences, the sequences are aligned for optimal comparison purposes (gaps are introduced in one or both of a first and a second amino acid or nucleic acid sequence as required for optimal alignment, and non-homologous sequences can be disregarded for comparison purposes). The length of a reference sequence aligned for comparison purposes is at least 50% (in some embodiments, about 50%, 55%, 60%, 65%, 70%, 75%, 85%, 90%, 95%, or 100% of the length of the reference sequence is aligned). The nucleotides or residues at corresponding positions are then compared. When a position in the first sequence is occupied by the same nucleotide or residue as the corresponding position in the second sequence, then the molecules are identical at that position. The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. For purposes of the present application, the percent identity between two amino acid sequences is determined using the Needleman and Wunsch ((1970) J. Mol. Biol. 48:444-453) algorithm which has been incorporated into the GAP program in the GCG software package, using a Blossum 62 scoring matrix with a gap penalty of 12, a gap extend penalty of 4, and a frameshift gap penalty of 5.

Cas9-HFD

Cas9-HFD are described in a U.S. Provisional Patent Application Ser. No. 61/799,647, Filed on Mar. 15, 2013, U.S. Ser. No. 61/838,148, filed on Jun. 21, 2013, and PCT International Application No. PCT/US14/27335, all of which are incorporated herein by reference in its entirety.

The Cas9-HFD are created by fusing a heterologous functional domain (e.g., a transcriptional activation domain, e.g., from VP64 or NF-κB p65), to the N-terminus or C-terminus of a catalytically inactive Cas9 protein (dCas9). In the present case, as noted above, the dCas9 can be from any species but is preferably from *S. pyogenes*, In some embodiments, the Cas9 contains mutations in the D10 and H840 residues, e.g., D10N/D10A and H840A/H840N/H840Y, to render the nuclease portion of the protein catalytically inactive, e.g., as shown in SEQ ID NO:33 above.

The transcriptional activation domains can be fused on the N or C terminus of the Cas9. In addition, although the present description exemplifies transcriptional activation domains, other heterologous functional domains (e.g., transcriptional repressors (e.g., KRAB, ERD, SID, and others, e.g., amino acids 473-530 of the ets2 repressor factor (ERF) repressor domain (ERD), amino acids 1-97 of the KRAB domain of KOX1, or amino acids 1-36 of the Mad mSIN3 interaction domain (SID); see Beerli et al., PNAS USA 95:14628-14633 (1998)) or silencers such as Heterochromatin Protein 1 (HP1, also known as swi6), e.g., HP1α or HP1β; proteins or peptides that could recruit long non-coding RNAs (lncRNAs) fused to a fixed RNA binding sequence such as those bound by the MS2 coat protein, endoribonuclease Csy4, or the lambda N protein; enzymes that modify the methylation state of DNA (e.g., DNA methyltransferase (DNMT) or TET proteins); or enzymes that modify histone subunits (e.g., histone acetyltransferases (HAT), histone deacetylases (HDAC), histone methyltransferases (e.g., for methylation of lysine or arginine residues) or histone demethylases (e.g., for demethylation of lysine or arginine residues)) as are known in the art can also be used. A number of sequences for such domains are known in the art, e.g., a domain that catalyzes hydroxylation of methylated cytosines in DNA. Exemplary proteins include the Ten-Eleven-Translocation (TET) 1-3 family, enzymes that converts 5-methylcytosine (5-mC) to 5-hydroxymethylcytosine (5-hmC) in DNA.

Sequences for human TET1-3 are known in the art and are shown in the following table:

| Gene | GenBank Accession Nos. | |
| --- | --- | --- |
| | Amino Acid | Nucleic Acid |
| TET1 | NP_085128.2 | NM_030625.2 |
| TET2* | NP_001120680.1 (var 1) | NM_001127208.2 |
| | NP_060098.3 (var 2) | NM_017628.4 |
| TET3 | NP_659430.1 | NM_144993.1 |

*Variant (1) represents the longer transcript and encodes the longer isoform (a). Variant (2) differs in the 5' UTR and in the 3' UTR and coding sequence compared to variant 1. The resulting isoform (b) is shorter and has a distinct C-terminus compared to isoform a.

In some embodiments, all or part of the full-length sequence of the catalytic domain can be included, e.g., a catalytic module comprising the cysteine-rich extension and the 2OGFeDO domain encoded by 7 highly conserved exons, e.g., the Tet1 catalytic domain comprising amino acids 1580-2052, Tet2 comprising amino acids 1290-1905 and Tet3 comprising amino acids 966-1678. See, e.g., FIG. 1 of Iyer et al., Cell Cycle. 2009 Jun. 1; 8(11):1698-710. Epub 2009 Jun. 27, for an alignment illustrating the key catalytic residues in all three Tet proteins, and the supplementary materials thereof (available at ftp site ftp.ncbi.nih-.gov/pub/aravind/DONS/supplementary_material_DON-S.html) for full length sequences (see, e.g., seq 2c); in some embodiments, the sequence includes amino acids 1418-2136 of Tet1 or the corresponding region in Tet2/3.

Other catalytic modules can be from the proteins identified in Iyer et al., 2009.

In some embodiments, the heterologous functional domain is a biological tether, and comprises all or part of (e.g., DNA binding domain from) the MS2 coat protein, endoribonuclease Csy4, or the lambda N protein. These proteins can be used to recruit RNA molecules containing a specific stem-loop structure to a locale specified by the dCas9 gRNA targeting sequences. For example, a dCas9 fused to MS2 coat protein, endoribonuclease Csy4, or lambda N can be used to recruit a long non-coding RNA (lncRNA) such as XIST or HOTAIR; see, e.g., Keryer-Bibens et al., Biol. Cell 100:125-138 (2008), that is linked to the Csy4, MS2 or lambda N binding sequence. Alternatively, the Csy4, MS2 or lambda N protein binding sequence can be linked to another protein, e.g., as described in Keryer-Bibens et al., supra, and the protein can be targeted to the dCas9 binding site using the methods and compositions described herein. In some embodiments, the Csy4 is catalytically inactive.

In some embodiments, the fusion proteins include a linker between the dCas9 and the heterologous functional domains. Linkers that can be used in these fusion proteins (or between fusion proteins in a concatenated structure) can include any sequence that does not interfere with the function of the fusion proteins. In preferred embodiments, the linkers are short, e.g., 2-20 amino acids, and are typically flexible (i.e., comprising amino acids with a high degree of freedom such as glycine, alanine, and serine). In some embodiments, the linker comprises one or more units consisting of GGGS (SEQ ID NO:34) or GGGGS (SEQ ID NO:35), e.g., two, three, four, or more repeats of the GGGS (SEQ ID NO:34) or GGGGS (SEQ ID NO:35) unit. Other linker sequences can also be used.

Expression Systems

In order to use the guide RNAs described, it may be desirable to express them from a nucleic acid that encodes them. This can be performed in a variety of ways. For example, the nucleic acid encoding the guide RNA can be cloned into an intermediate vector for transformation into prokaryotic or eukaryotic cells for replication and/or expression. Intermediate vectors are typically prokaryote vectors, e.g., plasmids, or shuttle vectors, or insect vectors, for storage or manipulation of the nucleic acid encoding the guide RNA for production of the guide RNA. The nucleic acid encoding the guide RNA can also be cloned into an expression vector, for administration to a plant cell, animal cell, preferably a mammalian cell or a human cell, fungal cell, bacterial cell, or protozoan cell.

To obtain expression, a sequence encoding a guide RNA is typically subcloned into an expression vector that contains a promoter to direct transcription. Suitable bacterial and eukaryotic promoters are well known in the art and described, e.g., in Sambrook et al., Molecular Cloning, A Laboratory Manual (3d ed. 2001); Kriegler, Gene Transfer and Expression: A Laboratory Manual (1990); and Current Protocols in Molecular Biology (Ausubel et al., eds., 2010). Bacterial expression systems for expressing the engineered protein are available in, e.g., E. coli, Bacillus sp., and Salmonella (Palva et al., 1983, Gene 22:229-235). Kits for such expression systems are commercially available. Eukaryotic expression systems for mammalian cells, yeast, and insect cells are well known in the art and are also commercially available.

The promoter used to direct expression of a nucleic acid depends on the particular application. For example, a strong constitutive promoter is typically used for expression and purification of fusion proteins. In contrast, when the guide RNA is to be administered in vivo for gene regulation, either a constitutive or an inducible promoter can be used, depending on the particular use of the guide RNA. In addition, a preferred promoter for administration of the guide RNA can be a weak promoter, such as HSV TK or a promoter having similar activity. The promoter can also include elements that are responsive to transactivation, e.g., hypoxia response elements, Gal4 response elements, lac repressor response element, and small molecule control systems such as tetracycline-regulated systems and the RU-486 system (see, e.g., Gossen & Bujard, 1992, Proc. Natl. Acad. Sci. USA, 89:5547; Oligino et al., 1998, Gene Ther., 5:491-496; Wang et al., 1997, Gene Ther., 4:432-441; Neering et al., 1996, Blood, 88:1147-55; and Rendahl et al., 1998, Nat. Biotechnol., 16:757-761).

In addition to the promoter, the expression vector typically contains a transcription unit or expression cassette that contains all the additional elements required for the expression of the nucleic acid in host cells, either prokaryotic or eukaryotic. A typical expression cassette thus contains a promoter operably linked, e.g., to the nucleic acid sequence encoding the gRNA, and any signals required, e.g., for efficient polyadenylation of the transcript, transcriptional termination, ribosome binding sites, or translation termination. Additional elements of the cassette may include, e.g., enhancers, and heterologous spliced intronic signals.

The particular expression vector used to transport the genetic information into the cell is selected with regard to the intended use of the gRNA, e.g., expression in plants, animals, bacteria, fungus, protozoa, etc. Standard bacterial expression vectors include plasmids such as pBR322 based plasmids, pSKF, pET23D, and commercially available tag-fusion expression systems such as GST and LacZ.

Expression vectors containing regulatory elements from eukaryotic viruses are often used in eukaryotic expression vectors, e.g., SV40 vectors, papilloma virus vectors, and vectors derived from Epstein-Barr virus. Other exemplary eukaryotic vectors include PMSG, pAV009/A+, pMTO10/A+, pMAMneo-5, baculovirus pDSVE, and any other vector allowing expression of proteins under the direction of the SV40 early promoter, SV40 late promoter, metallothionein promoter, murine mammary tumor virus promoter, Rous sarcoma virus promoter, polyhedrin promoter, or other promoters shown effective for expression in eukaryotic cells.

The vectors for expressing the guide RNAs can include RNA Pol III promoters to drive expression of the guide RNAs, e.g., the H1, U6 or 7SK promoters. These human promoters allow for expression of gRNAs in mammalian cells following plasmid transfection. Alternatively, a T7 promoter may be used, e.g., for in vitro transcription, and the RNA can be transcribed in vitro and purified. Vectors suitable for the expression of short RNAs, e.g., siRNAs, shRNAs, or other small RNAs, can be used.

Some expression systems have markers for selection of stably transfected cell lines such as thymidine kinase, hygromycin B phosphotransferase, and dihydrofolate reductase. High yield expression systems are also suitable, such as using a baculovirus vector in insect cells, with the gRNA encoding sequence under the direction of the polyhedrin promoter or other strong baculovirus promoters.

The elements that are typically included in expression vectors also include a replicon that functions in *E. coli*, a gene encoding antibiotic resistance to permit selection of bacteria that harbor recombinant plasmids, and unique restriction sites in nonessential regions of the plasmid to allow insertion of recombinant sequences.

Standard transfection methods are used to produce bacterial, mammalian, yeast or insect cell lines that express large quantities of protein, which are then purified using standard techniques (see, e.g., Colley et al., 1989, J. Biol. Chem., 264:17619-22; Guide to Protein Purification, in Methods in Enzymology, vol. 182 (Deutscher, ed., 1990)). Transformation of eukaryotic and prokaryotic cells are performed according to standard techniques (see, e.g., Morrison, 1977, J. Bacteriol. 132:349-351; Clark-Curtiss & Curtiss, Methods in Enzymology 101:347-362 (Wu et al., eds, 1983).

Any of the known procedures for introducing foreign nucleotide sequences into host cells may be used. These include the use of calcium phosphate transfection, polybrene, protoplast fusion, electroporation, nucleofection, liposomes, microinjection, naked DNA, plasmid vectors, viral vectors, both episomal and integrative, and any of the other well-known methods for introducing cloned genomic DNA, cDNA, synthetic DNA or other foreign genetic material into a host cell (see, e.g., Sambrook et al., supra). It is only necessary that the particular genetic engineering procedure used be capable of successfully introducing at least one gene into the host cell capable of expressing the gRNA.

The present invention includes the vectors and cells comprising the vectors.

EXAMPLES

The invention is further described in the following examples, which do not limit the scope of the invention described in the claims.

Example 1. Assessing Specificity of RNA-Guided Endonucleases

CRISPR RNA-guided nucleases (RGNs) have rapidly emerged as a facile and efficient platform for genome editing. This example describes the use of a human cell-based reporter assay to characterize off-target cleavage of Cas9-based RGNs.

Materials and Methods

The following materials and methods were used in Example 1.

Construction of Guide RNAs

DNA oligonucleotides (Table A) harboring variable 20 nt sequences for Cas9 targeting were annealed to generate short double-strand DNA fragments with 4 bp overhangs compatible with ligation into BsmBI-digested plasmid pMLM3636. Cloning of these annealed oligonucleotides generates plasmids encoding a chimeric+103 single-chain guide RNA with 20 variable 5' nucleotides under expression of a U6 promoter (Hwang et al., Nat Biotechnol 31, 227-229 (2013); Mali et al., Science 339, 823-826 (2013)). pMLM3636 and the expression plasmid pJDS246 (encoding a codon optimized version of Cas9) used in this study are both available through the non-profit plasmid distribution service Addgene (addgene.org/crispr-cas).

TABLE A

| gRNA Target Sequence Position | | | | | | | | | | | | | | | | | | | | Oligos for generating gRNA expression plasmid | | | | |
|---|---|---|---|---|---|---|---|---|---|---|---|---|---|---|---|---|---|---|---|---|---|---|---|---|
| 20 | 19 | 18 | 17 | 16 | 15 | 14 | 13 | 12 | 11 | 10 | 9 | 8 | 7 | 6 | 5 | 4 | 3 | 2 | 1 | oligonucleotide 1 (5' to 3') | # | oligonucleotide 2 (5' to 3') | # |
| | | | | | | | | | | | | | | | | | | | | EGFP Target Site 1 | | | |
| G | G | G | C | A | C | G | G | C | C | A | G | C | T | T | G | C | C | G | G | ACACCGGGCACGGCAGCTTGCCGGGG | 36. | AAAACCCCGGCAAGCTGCCGTGCCCG | 230. |
| G | G | G | C | A | C | G | G | C | C | A | G | C | T | T | G | C | C | G | c | ACACCGGGCACGGCAGCTTGCCGCGG | 37. | AAAACGCGGCAAGCTGCCGTGCCCG | 231. |
| G | G | G | C | A | C | G | G | C | C | A | G | C | T | T | G | C | C | G | G | ACACCGGGCACGGCAGCTTGCCGGGG | 38. | AAAACCCCGGCAAGCTGCCGTGCCCG | 232. |
| G | G | G | C | A | C | G | G | C | C | A | G | C | T | T | G | C | C | G | G | ACACCGGGCACGGCAGCTTGCCGGGG | 39. | AAAACCCCGGCAAGCTGCCGTGCCCG | 233. |
| G | G | G | C | A | C | G | G | C | C | A | G | C | T | T | G | gc | C | G | G | ACACCGGGCACGGCAGCTTGgCCGGGG | 40. | AAAACCCCGGCAAGCTGCCGTGCCCG | 234. |
| G | G | G | C | A | C | G | G | C | C | A | G | C | T | T | G | C | C | G | G | ACACCGGGCACGGCAGCTTGCCGGGG | 41. | AAAACCCCGGGAAGCTGCCGTGCCCG | 235. |
| G | G | G | C | A | C | G | G | C | C | A | G | C | T | T | G | C | C | G | G | ACACCGGGCACGGCAGCTAGCCGGG | 42. | AAAACCCGGCTAGCTGCCGTGCCCG | 236. |
| G | G | G | C | A | C | G | G | C | C | A | G | C | T | gc | a | C | C | G | G | ACACCGGGCACGGCAGCATGCCGGG | 43. | AAAACCCGGCATGCTGCCGTGCCCG | 237. |
| G | G | G | C | A | C | G | G | C | C | A | G | C | T | T | G | C | C | G | G | ACACCGGGCACGGCACCTTGCCGGG | 44. | AAAACCCGGCAACCTGCCGTGCCCG | 238. |
| G | G | G | C | A | C | G | G | C | C | A | G | gc | C | T | G | C | C | G | G | ACACCGGGCACGGGCACCTTGCCGGG | 45. | AAAACCCGGCAAGGTGCCGTGCCCG | 239. |
| G | G | G | C | A | C | G | G | C | C | A | G | C | T | T | G | C | C | G | G | ACACCGGGCACGGCAGACCTTGCCGG | 46. | AAAACCCGGCAAGCTCCCGTGCCCG | 240. |
| G | G | G | C | A | C | G | G | C | C | A | G | C | T | T | G | C | C | G | G | ACACCGGGCACGGCAGCTCCCCGGG | 47. | AAAACCCGGGAACTCCCGTGCCCG | 241. |
| G | G | G | C | A | C | G | G | C | C | A | G | C | T | T | G | C | C | G | G | ACACCGGGCACGGCAGCTTGCCGGGG | 48. | AAAACCCGGCAAGCTGGCGTGCCCG | 242. |
| G | G | G | C | A | C | G | G | C | C | A | G | C | T | T | G | C | C | G | G | ACACCGGGCACGGCAGCTTGCCGGGG | 49. | AAAACCCGGCAAGCTGCGGTGCCCG | 243. |
| G | G | G | C | A | C | G | G | C | C | A | G | C | T | T | G | C | C | G | G | ACACCGGGCACGGCAGCTTGCCGGGG | 50. | AAAACCCGGCAAGCTGCCGGTGCCCG | 244. |
| G | G | G | C | A | C | G | G | C | C | A | G | gc | C | T | G | C | C | G | G | ACACCGGGCAGGGCTCGGGCAGCTTGCCGGG | 51. | AAAACCCGGCAAGCTGCCCTGCCCG | 245. |
| G | G | G | C | A | C | G | G | C | C | A | G | C | T | T | G | C | C | G | G | ACACCGGGGACGGGCAGCTTGCCGGG | 52. | AAAACCCGGCAAGCTGCCCGAGCCG | 246. |
| G | G | G | C | A | C | G | G | C | C | A | G | C | T | T | G | C | C | G | G | ACACCGGGGACGGGCAGCTTGCCGGG | 53. | AAAACCCGGCAAGCTGCCCGTCCCG | 247. |
| G | G | G | C | A | C | G | G | C | C | A | G | C | T | T | G | C | C | G | G | ACACCGGCCGCACGGCAGCTTGCCGGG | 54. | AAAACCCGGCAAGCTGCCGTGGCCG | 248. |
| G | G | G | C | A | C | G | G | C | C | A | G | C | T | T | G | C | C | G | G | ACACCGGCCGCACGGCAGCTTGCCGGG | 55. | AAAACCCGGCAAGCTGCCGTGCCCG | 249. |
| G | G | G | C | A | C | G | G | C | C | A | G | C | T | T | G | C | C | G | G | ACACCGGCCGCACGGCAGCTTGCCCCG | 56. | AAAACGGGGCAAGCTGCCGTGCCCG | 250. |
| G | G | G | C | A | C | G | G | C | C | A | G | C | T | T | G | C | C | G | G | ACACCGGGCACGGCAGCTACCGGG | 57. | AAAACCCCGGGTAGCTGCCGTGCCCG | 251. |
| G | G | G | C | A | C | G | G | C | C | A | G | C | T | T | G | C | C | G | G | ACACCGGGCACGGCAGCATCCTGCCGG | 58. | AAAACCATCCTGCCGTGCCCG | 252. |
| G | G | G | c | C | C | G | G | C | gc | a | c | gc | a | T | c | C | gc | G | c | ACACCGGGCACGGCAGGATGCCGGG | 59. | AAAACCCGGCAAGGAGCTGCCGTGCCCG | 253. |
| G | G | G | C | A | C | G | G | C | C | A | G | C | T | T | G | C | C | G | G | ACACCGGGCACGGCAGCTTGCCGGG | 60. | AAAACCCGGCAAGCTGCCGTGCCCG | 254. |
| G | G | G | C | A | C | G | G | C | C | A | G | C | T | T | G | C | C | G | G | ACACCGGCCGCACGGCAGCTTGCCGGG | 61. | AAAACCCGGCAAGCTGCCGTGCCCG | 255. |
| G | G | G | C | A | C | G | G | C | C | A | G | C | T | T | G | C | C | G | G | ACACCGCCGACGGCACCTTGCCGGG | 62. | AAAACCCGGCAAGCTGCGGGTGCCCG | 256. |
| G | G | G | C | A | C | G | G | C | C | A | G | C | T | T | G | C | C | G | G | ACACCGCCGTGGGCAGCCAGCTTGCCGGG | 63. | AAAACCCGGCAAGCTGCCAGCCCG | 257. |
| G | G | G | C | A | C | G | G | C | C | A | G | C | T | T | G | C | C | G | G | ACACCGCCGTGGCAGCTTGCCGGG | 64. | AAAACCCGGCAAGCTGCCGTGCCCG | 258. |
| G | G | G | C | A | C | G | G | C | C | A | G | C | T | T | G | C | C | G | G | ACACCGCCGCACGGCAGCTTGCCGGG | 65. | AAAACCCGGCAAGCTGCCGTGTGGGG | 259. |
| G | G | G | C | A | C | G | G | C | C | A | G | C | T | T | G | C | C | G | G | ACACCGGGCACCGGCAGCTTGCCGGG | 66. | AAAACCCGGCAAGCTGCGGGGTGCCCG | 260. |
| G | G | c | C | A | gc | G | g | c | gc | A | gc | C | T | T | G | C | C | G | G | ACACCGGGCTGGGCAGCTTGCCGGG | 67. | AAAACCCGGCAAGCTGCCAGCCG | 261. |
| G | G | G | C | A | C | G | G | C | C | A | G | C | T | T | G | C | C | G | G | ACACCGGGCGAGACGGCAGCTTGCCGGG | 68. | AAAACCCGGCAAGCTGCCGTGCCCG | 262. |
| G | G | G | C | A | C | G | G | C | C | A | G | C | T | T | G | C | C | G | G | ACACCGGGCCCACGGCAGCTTGCCGGG | 69. | AAAACCCGGCAAGCTGCCGTGCCCG | 263. |
| G | G | G | C | A | C | G | G | C | C | A | G | C | T | T | G | C | C | G | G | ACACCGGGCGTGCCGCAGCTTGCCGGG | 70. | AAAACCCGGCAAGCTGCCGTGCCCG | 264. |
| G | G | G | C | A | C | G | G | C | C | A | G | C | T | T | G | C | C | G | G | ACACCGGGCGTGCCCAGCTTGCCGGG | 71. | AAAACCCGGCAAGCTGCCGTGCCCG | 265. |
| G | G | G | C | A | C | G | G | C | C | A | G | C | T | T | G | C | C | G | G | ACACCGGGCGGGCAGCAGCTTGCCGGG | 72. | AAAACCCGGCAAGCTGCCCGTGCCCG | 266. |
| G | G | G | C | A | C | G | G | C | C | A | G | C | T | T | G | C | C | G | G | ACACCGGGCGGGCAGCCACCTTGCCGGG | 73. | AAAACCCGGCAAGGTGGCCGTGCCCG | 267. |
| G | G | G | C | A | C | G | G | C | C | A | G | C | T | T | G | C | C | G | G | ACACCGGGCGGGCAGCTCCCGGGG | 74. | AAAACCGCGGAAGCTGCCGTGCCCG | 268. |
| G | G | G | c | c | gc | g | gc | gc | gc | A | c | C | T | T | G | gc | gc | G | G | ACACCGGGCGGGCAGCATGCCGGG | 75. | AAAACCCGGCATGCTGCCGTGCCCG | 269. |
| G | G | G | C | A | C | G | G | C | C | A | G | C | T | T | G | C | C | G | G | ACACCGGGCGGGCAGACCTTGCCGGG | 76. | AAAACCCGGCAACCTGCCGTGCCCG | 270. |
| G | G | G | c | gc | c | g | g | c | c | A | c | C | T | T | G | gc | gc | G | G | ACACCGGGCGGGCAGCTTGCCGGG | 77. | AAAACCCGGCAAGGTGCCGTGCCCG | 271. |
| G | G | G | c | gc | c | g | g | c | c | A | c | C | T | T | G | gc | gc | G | G | ACACCGGGCGGGAGCTTGCCGGGG | 78. | AAAACCCCGGCAAGCTCCCGTGCCCG | 272. |
| G | G | G | c | A | c | g | g | c | c | A | c | C | T | T | G | gc | gc | G | G | ACACCGGGGAGGGCAGCTTGCCGGG | 79. | AAAACCCGGCAAGCTGCCCTGCCCG | 273. |
| G | G | G | c | A | c | g | g | c | c | A | c | C | T | T | G | gc | gc | G | G | ACACCGGGGAGGGCAGCTTGCCGGGG | 80. | AAAACCCCGGCAAGCTGCCCGTCCCG | 274. |

TABLE A-continued

| gRNA Target Sequence Position | | | | | | | | | | | | | | | | | | | | | Oligos for generating gRNA expression plasmid | | | | |
|---|---|---|---|---|---|---|---|---|---|---|---|---|---|---|---|---|---|---|---|---|---|---|---|---|---|
| 20 | 19 | 18 | 17 | 16 | 15 | 14 | 13 | 12 | 11 | 10 | 9 | 8 | 7 | 6 | 5 | 4 | 3 | 2 | 1 | oligonucleotide 1 (5' to 3') | # | oligonucleotide 2 (5' to 3') | # |
| G | c | G | A | A | C | G | G | G | C | A | G | C | T | T | G | C | g | G | G | ACACCGCGCACGGGCAGCTTGCCGGG | 81. | AAAACCCGCAAGCTGCCCGTGCGCG | 275. |
| G | G | G | C | A | C | G | G | G | g | A | G | C | T | T | G | C | C | G | G | ACACCGGGCACGGGGAGCTTGCCGCG | 82. | AAAACGCGGCAAGCTCCCGTGCCCG | 276. |
| G | G | G | C | A | C | G | G | G | g | A | G | C | T | T | G | C | C | G | G | ACACCGGGCACGGGGAGCTTGCCCGG | 83. | AAAACCGGGAAGCTCCCGTGCCCG | 277. |
| G | G | G | C | A | C | G | G | G | g | A | G | C | a | T | G | C | C | G | G | ACACCGGGCACGGGGAGCATGCCGGG | 84. | AAAACCCGGCATGCTCCCGTGCCCG | 278. |
| G | G | G | C | A | C | G | G | G | g | A | c | C | T | T | G | C | C | G | G | ACACCGGGCACGGGGACCTTGCCGGG | 85. | AAAACCCGGCAAGGTCCCGTGCCCG | 279. |
| G | G | G | C | A | C | G | G | G | g | A | G | C | T | T | G | C | C | G | G | ACACCGGGCAGGGGAGCTTGCCGGG | 86. | AAAACCCGGCAAGCTCCCCTGCCCG | 280. |
| G | G | G | C | A | C | G | G | G | g | A | G | C | T | T | G | C | C | G | G | ACACCGGGCAGGGGAGCTTGCCCGG | 87. | AAAACCGGGCAAGCTCCCCTGCCCG | 281. |
| G | c | G | C | A | C | G | G | G | g | A | G | C | T | T | G | C | C | G | G | ACACCGCGCAGGGGAGCTTGCCGGG | 88. | AAAACCCGGCAAGCTCCCCTGCGCG | 282. |
| G | c | G | C | A | C | G | C | G | C | A | G | C | T | T | G | C | C | G | G | ACACCGCGCACGCGCAGCTTGCCGGG | 89. | AAAACCCGGCAAGCTGCGCGTGCGCG | 283. |
| G | G | G | C | A | C | G | G | G | C | A | G | C | T | T | c | C | C | G | G | ACACCGGGCACGGGCAGCTTCCCGGG | 90. | AAAACCGGGAAGCTGCCCGTGCCCG | 284. |
| G | c | G | C | A | C | G | G | G | C | A | G | C | T | T | G | C | C | G | G | ACACCGCGCACGGGCAGCTTGCCGGG | 91. | AAAACCGGCAAGCTGCCCGTGCGCG | 285. |
| G | G | G | C | A | C | G | G | G | C | A | G | C | a | T | G | C | C | G | G | ACACCGGGCACGGGCAGCATGCCGGG | 92. | AAAACCGGCATGCTGCCCGTGCCCG | 286. |
| G | G | G | C | A | C | G | G | G | C | A | c | C | T | T | G | C | C | G | G | ACACCGGGCACGGGCACCTTGCCGGG | 93. | AAAACCGGCAAGGTGCCCGTGCCCG | 287. |
| G | G | G | C | A | c | G | G | G | C | A | G | C | T | T | G | C | C | G | G | ACACCGGGCAcGGGCAGCTTGCCGGG | 94. | AAAACCGGCAAGCTGCCCGTGCgCCG | 288. |
| G | c | G | C | A | C | G | G | G | C | A | G | C | T | T | G | C | C | G | G | ACACCGCGCAGGGCAGCTTGCCGGG | 95. | AAAACCGGCAAGCTGCCCTGCGCG | 289. |
| G | G | G | C | A | C | G | G | G | C | A | G | C | a | T | G | C | C | G | G | ACACCGGGCAGGGCAGCATGCCGGG | 96. | AAAACCGGCATGCTGCCCTGCCCG | 290. |

EGFP Target Site 2

| G | A | T | G | C | C | G | T | T | C | T | T | C | T | G | C | T | T | G | T | ACACCGATGCCGTTCTTCTGCTTGTG | 97. | AAAACACAAGCAGAAGAACGGCATCG | 291. |
| G | A | T | G | C | C | G | T | T | C | T | T | C | T | G | C | T | T | G | a | ACACCGATGCCGTTCTTCTGCTTGAG | 98. | AAAACACAAGCAGAAGAACGGCATCG | 292. |
| G | A | T | G | C | C | G | T | T | C | T | T | C | T | G | C | T | T | c | T | ACACCGATGCCGTTCTTCTGCTTCTG | 99. | AAAACACAAGCAGAAGAACGGCATCG | 293. |
| G | A | T | G | C | C | G | T | T | C | T | T | C | T | G | C | T | a | G | T | ACACCGATGCCGTTCTTCTGCTAGTG | 100. | AAAACACAAGCAGAAGAACGGCATCG | 294. |
| G | A | T | G | C | C | G | T | T | C | T | T | C | T | G | C | a | T | G | T | ACACCGATGCCGTTCTTCTGCATGTG | 101. | AAAACACAAGCAGAAGAACGGCATCG | 295. |
| G | A | T | G | C | C | G | T | T | C | T | T | C | T | G | g | T | T | G | T | ACACCGATGCCGTTCTTCTGGTTGTG | 102. | AAAACACAAGCAGAAGAACGGCATCG | 296. |
| G | A | T | G | C | C | G | T | T | C | T | T | C | T | c | C | T | T | G | T | ACACCGATGCCGTTCTTCTCCTTGTG | 103. | AAAACACAAGCAGAAGAACGGCATCG | 297. |
| G | A | T | G | C | C | G | T | T | C | T | T | C | a | G | C | T | T | G | T | ACACCGATGCCGTTCTTCAGCTTGTG | 104. | AAAACACAAGCAGAAGAACGGCATCG | 298. |
| G | A | T | G | C | C | G | T | T | C | T | T | g | T | G | C | T | T | G | T | ACACCGATGCCGTTCTTGTGCTTGTG | 105. | AAAACACAAGCAGAAGAACGGCATCG | 299. |
| G | A | T | G | C | C | G | T | T | C | T | a | C | T | G | C | T | T | G | T | ACACCGATGCCGTTCTACTGCTTGTG | 106. | AAAACACAAGCAGAAGAACGGCATCG | 300. |
| G | A | T | G | C | C | G | T | T | C | a | T | C | T | G | C | T | T | G | T | ACACCGATGCCGTTCATCTGCTTGTG | 107. | AAAACACAAGCAGAAGAACGGCATCG | 301. |
| G | A | T | G | C | C | G | T | T | g | T | T | C | T | G | C | T | T | G | T | ACACCGATGCCGTTGTTCTGCTTGTG | 108. | AAAACACAAGCAGAAGAACGGCATCG | 302. |
| G | A | T | G | C | C | G | T | a | C | T | T | C | T | G | C | T | T | G | T | ACACCGATGCCGTACTTCTGCTTGTG | 109. | AAAACACAAGCAGAAGAACGGCATCG | 303. |
| G | A | T | G | C | C | G | a | T | C | T | T | C | T | G | C | T | T | G | T | ACACCGATGCCGATCTTCTGCTTGTG | 110. | AAAACACAAGCAGAAGAACGGCATCG | 304. |
| G | A | T | G | C | C | c | T | T | C | T | T | C | T | G | C | T | T | G | T | ACACCGATGCCCTTCTTCTGCTTGTG | 111. | AAAACACAAGCAGAAGAACGGGCATCG | 305. |
| G | A | T | G | C | g | G | T | T | C | T | T | C | T | G | C | T | T | G | T | ACACCGATGCGGTTCTTCTGCTTGTG | 112. | AAAACACAAGCAGAAGAACCGCATCG | 306. |
| G | A | T | G | g | C | G | T | T | C | T | T | C | T | G | C | T | T | G | T | ACACCGATGGCGTTCTTCTGCTTGTG | 113. | AAAACACAAGCAGAAGAACGCCATCG | 307. |
| G | A | T | c | C | C | G | T | T | C | T | T | C | T | G | C | T | T | G | T | ACACCGATCCCGTTCTTCTGCTTGTG | 114. | AAAACACAAGCAGAAGAACGGGATCG | 308. |
| G | A | a | G | C | C | G | T | T | C | T | T | C | T | G | C | T | T | G | T | ACACCGAAGCCGTTCTTCTGCTTGTG | 115. | AAAACACAAGCAGAAGAACGGCTTCG | 309. |
| G | t | T | G | C | C | G | T | T | C | T | T | C | T | G | C | T | T | G | T | ACACCGTTGCCGTTCTTCTGCTTGTG | 116. | AAAACACAAGCAGAAGAACGGCAACG | 310. |
| G | A | T | G | C | C | G | T | T | C | T | T | C | T | G | C | T | T | c | T | ACACCGATGCCGTTCTTCTGCTTCAG | 117. | AAAACTGAAGCAGAAGAACGGCATCG | 311. |
| G | A | T | G | C | C | G | T | T | C | T | T | C | T | G | C | a | a | G | T | ACACCGATGCCGTTCTTCTGCAAGTG | 118. | AAAACACTTGCAGAAGAACGGCATCG | 312. |
| G | A | T | G | C | C | G | T | T | C | T | c | g | T | G | C | T | T | G | T | ACACCGATGCCGTTCTCGTTGCTTGTG | 119. | AAAACACAAGCAACGAGAACGGCATCG | 313. |
| G | A | T | G | C | C | G | T | T | C | a | a | C | T | G | C | T | T | G | T | ACACCGATGCCGTTCAACTGCTTGTG | 120. | AAAACACAAGCAGTTGAACGGCATCG | 314. |
| G | A | T | G | C | C | G | T | a | g | T | T | C | T | G | C | T | T | G | T | ACACCGATGCCGTAGTTCTTGTG | 121. | AAAACACAAGCTCAACTACGGCATCG | 315. |
| G | A | T | G | C | C | c | a | T | C | T | T | C | T | G | C | T | T | G | T | ACACCGATGCCCATCTTCTGCTTGTG | 122. | AAAACACAAGCAGAAGATGGGCATCG | 316. |
| G | A | T | G | g | g | G | T | T | C | T | T | C | T | G | C | T | T | G | T | ACACCGATGGGGTTCTTCTGCTTGTG | 123. | AAAACACAAGCAGAAGAACCCCATCG | 317. |
| G | A | a | a | C | C | G | T | T | C | T | T | C | T | G | C | T | T | G | T | ACACCGAACCCATCTTCTGCTTGTG | 124. | AAAACACAAGCAGAAGAACGGTTTCG | 318. |
| G | t | a | G | C | C | G | T | T | C | T | T | C | T | G | C | T | T | G | T | ACACCGTAGCCGTTCTTCTGCTTGTG | 125. | AAAACACAAGCAGAAGAACGGCTACG | 319. |
| G | a | t | g | C | C | G | a | a | C | T | T | C | T | G | C | T | T | G | T | ACACCGAACGAACTTCTGCTTGTG | 126. | AAAACACAAGCAGAAGACGCAAGG | 320. |

TABLE A-continued

| gRNA Target Sequence Position | | | | | | | | | | | | | | | | | | | | Oligos for generating gRNA expression plasmid | | | |
|---|---|---|---|---|---|---|---|---|---|---|---|---|---|---|---|---|---|---|---|---|---|---|---|
| 1 | 2 | 3 | 4 | 5 | 6 | 7 | 8 | 9 | 10 | 11 | 12 | 13 | 14 | 15 | 16 | 17 | 18 | 19 | 20 | oligonucleotide 1 (5' to 3') | # | oligonucleotide 2 (5' to 3') | # |
| T | G | T | T | C | G | T | C | T | T | C | T | T | G | C | C | c | a | t | G | ACACCGTACCGTTCTTCTGCTTGTG | 127. | AAAACACAAGCAAGAACAGAAGAACGGGTACG | 321. |
| T | G | T | T | C | G | T | C | T | T | C | T | T | C | C | g | c | a | t | G | ACACCGTACGCGTTCTTCTGCTTGTG | 128. | AAAACACAAGCAAGAACGAGAAGAACGCGTACG | 322. |
| T | G | T | T | C | G | T | C | T | T | C | T | T | C | g | g | c | a | t | G | ACACCGTACGGGTTCTTCTGCTTGTG | 129. | AAAACACAAGCAAGAACCCGTACG | 323. |
| T | G | T | T | C | G | T | C | T | T | C | T | T | C | C | g | c | a | t | G | ACACCGTACCGGTTCTTCTGCTTGTG | 130. | AAAACACAAGCAAGAAGCCGTACG | 324. |
| T | G | T | T | C | G | T | C | T | T | C | T | T | G | C | C | c | a | A | G | ACACCGTACCGGCATTCTGCTTGTG | 131. | AAAACACAAGCAAGAATGCCGTACG | 325. |
| T | G | T | T | C | G | T | C | T | T | C | T | T | G | C | C | T | a | A | G | ACACCGTACCGGCAACTTCTGCTTGTG | 132. | AAAACACAAGCAAGAAGTTGCCGTACG | 326. |
| T | G | T | T | C | G | T | C | T | T | C | T | T | G | C | C | T | T | C | G | ACACCGTACGGCAAGTTCTGCTTGTG | 133. | AAAACACAAGCAAGAACTTGCCGTACG | 327. |
| T | G | T | T | C | G | T | C | T | T | C | T | T | a | C | C | T | A | A | G | ACACCGATGCGTTCTTCTCTAGAG | 134. | AAAACTCTAGCAGAAGAACGGCATCG | 328. |
| T | G | T | T | C | G | T | C | T | T | C | a | a | g | C | C | T | A | A | G | ACACCGATGCGTTCTTCTGGTAGTG | 135. | AAAACACTAGCTGAAGAACGGCATCG | 329. |
| T | G | T | T | C | G | T | C | T | T | a | a | T | G | C | C | T | A | A | G | ACACCGATGCGTTCTTCACTAGTG | 136. | AAAACACTAGTGAAGAACGGCATCG | 330. |
| T | G | T | T | C | G | T | a | a | T | C | T | T | G | C | C | T | A | A | G | ACACCGATGCGTTCCAGTAGTG | 137. | AAAACACTAGCAGTAGAACGGCATCG | 331. |
| T | G | T | T | C | a | a | C | T | T | C | T | T | G | C | C | T | A | A | G | ACACCGATGCGTTGTTCTGCTAGTG | 138. | AAAACTAGCAGAACAACGGCATCG | 332. |
| T | a | a | T | C | G | T | C | T | T | C | T | T | G | C | C | T | A | A | G | ACACCGATGCCGATCTTCTGCTAGTG | 139. | AAAACTAGCAGAAGATCGGCATCG | 333. |
| T | G | T | T | C | G | T | C | T | T | C | T | T | G | C | C | T | A | A | G | ACACCGATCCGTTCTTCTGCTAGTG | 140. | AAAACACTAGCAGAAGAACGGATCG | 334. |
| T | G | T | T | C | G | T | C | T | a | a | T | T | G | C | C | T | A | A | G | ACACCGATGCGTTCTTCTAGCTAGTG | 141. | AAAACACTAGCTAGAACGGGATCG | 335. |
| T | G | T | T | C | G | T | C | T | T | C | T | a | a | C | C | T | A | A | G | ACACCGATGCGTTCTTCTGCTAGTG | 142. | AAAACACTAGCAGAAACGGCATCG | 336. |
| T | G | T | T | C | G | T | C | T | T | C | T | a | g | C | C | T | A | A | G | ACACCGATGCCGTTGTTCTGCTAGTG | 143. | AAAACTCAAGCAGAAGAAGAATCGGCATCG | 337. |
| T | G | T | T | C | G | T | C | T | T | C | T | T | G | C | C | T | A | A | G | ACACCGATGCCGATCTTGTTCTGCTAGTG | 144. | AAAACACAAGCAAGAAGAATCGGCATCG | 338. |
| T | G | T | T | C | G | T | C | T | T | C | T | T | G | C | C | T | A | A | G | ACACCGATGCGTTGTTCAGCTAGTG | 145. | AAAACTGAACAACGGCATCG | 339. |
| T | G | T | T | C | G | T | C | T | T | C | T | T | a | C | C | T | A | A | G | ACACCGATGCGTTGTACTGCTAGTG | 146. | AAAACAGTACAACGGCATCG | 340. |
| T | G | T | T | C | G | T | C | T | T | C | T | T | G | C | C | T | A | A | G | ACACCGATGCCGATGTTCTGCTTGTG | 147. | AAAACTCAAGCAGAACATCGGCATCG | 341. |
| T | G | T | T | C | G | T | C | T | T | C | T | T | G | C | C | T | A | A | G | ACACCGATGCGGGTTCTTCTGCTTGTG | 148. | AAAACACAAGCAAGAACCGGATCG | 342. |
| T | G | T | T | C | G | T | C | T | T | C | T | T | G | C | C | T | A | A | G | ACACCGATCCGTTGTTCTGCTTGTG | 149. | AAAACACAAGCAAGAACGGGATCG | 343. |
| T | G | T | T | C | G | T | C | T | T | C | T | T | G | C | C | T | A | A | G | ACACCGTTGCCGTTCTTCTGCTTGTG | 150. | AAAACACAAGCAGAAGAACGGCAACG | 344. |
| T | G | T | T | C | G | T | C | a | a | C | T | T | G | C | C | T | A | A | G | ACACCGTTGCCGTTCTTCTTGAG | 151. | AAAACTCAAGCAAGAACGGCAACG | 345. |
| T | G | T | T | C | G | T | C | T | T | C | T | T | G | C | C | T | A | A | G | ACACCGTTGCCGTTCTTGGTGTG | 152. | AAAACACAAGCAAGAACGGCAACG | 346. |
| T | G | T | T | C | G | T | C | T | T | C | T | T | G | C | C | T | A | A | G | ACACCGTTGCCGTTCTACTCTTGTG | 153. | AAAACACAAGCTGAAGAACGGCAACG | 347. |
| T | G | T | T | C | G | T | C | T | T | C | T | T | G | C | C | T | A | A | G | ACACCGTTGCCGTCACTCTGCTTGTG | 154. | AAAACACAAGCAAGAGTAGAACGGCAACG | 348. |
| T | G | T | T | C | G | T | C | T | T | C | T | T | G | C | C | T | A | A | G | ACACCGTTGCCGATCTTCTGCTTGTG | 155. | AAAACACAAGCAAGAAGATCGGCAACG | 349. |
| T | G | T | T | C | G | T | C | T | T | C | T | T | G | C | C | T | T | T | G | ACACCGTTGCGGTTCTTCTGCTTGTG | 156. | AAAACACAAGCAAGAACCGCAACG | 350. |
| T | G | T | T | C | G | T | C | T | T | C | T | T | G | C | C | T | c | T | G | ACACCGTTCCGTTCTTCTGCTTGTG | 157. | AAAACACAAGCAAGAACGGAACG | 351. |

EGFP Target Site 3

| 1 | 2 | 3 | 4 | 5 | 6 | 7 | 8 | 9 | 10 | 11 | 12 | 13 | 14 | 15 | 16 | 17 | 18 | 19 | 20 | oligonucleotide 1 (5' to 3') | # | oligonucleotide 2 (5' to 3') | # |
| A | C | T | T | C | A | A | G | A | A | G | A | C | C | T | G | G | T | G | G | ACACCGGTGGTGCAGATGAACTTCAG | 158. | AAAACTGAAGTTCATCTGCACCACCG | 352. |
| t | C | T | T | C | A | A | G | A | A | G | A | C | C | T | G | G | T | G | G | ACACCGGTGGTGCAGATGAACTTCTG | 159. | AAAACAGAAGTTCATCTGCACCACCG | 353. |
| A | g | T | T | C | A | A | G | A | A | G | A | C | C | T | G | G | T | G | G | ACACCGGTGGTGCAGATGAACTGAG | 160. | AAAACTCAAGTTCATCTGCACCACCG | 354. |
| A | C | a | T | C | A | A | G | A | A | G | A | C | C | T | G | G | T | G | G | ACACCGGTGGTGCAGATGAACTACAG | 161. | AAAACTGTAGTTCATCTGCACCACCG | 355. |
| A | C | T | a | C | A | A | G | A | A | G | A | C | C | T | G | G | T | G | G | ACACCGGTGGTGCAGATGAACATCAG | 162. | AAAACTGATGTTCATCTGCACCACCG | 356. |
| A | C | T | T | a | A | A | G | A | A | G | A | C | C | T | G | G | T | G | G | ACACCGGTGGTGCAGATGAAGTTCAG | 163. | AAAACTGAACTTCATCTGCACCACCG | 357. |
| A | C | T | T | C | t | A | G | A | A | G | A | C | C | T | G | G | T | G | G | ACACCGGTGGTGCAGATGATCTTCAG | 164. | AAAACTGAAGATCATCTGCACCACCG | 358. |
| A | C | T | T | C | A | t | G | A | A | G | A | C | C | T | G | G | T | G | G | ACACCGGTGGTGCAGATGTACTTCAG | 165. | AAAACTGAAGTACATCTGCACCACCG | 359. |
| A | C | T | T | C | A | A | c | A | A | G | A | C | C | T | G | G | T | G | G | ACACCGGTGGTGCAGATCATCTTCAG | 166. | AAAACTGAAGTTGATCTGCACCACCG | 360. |
| A | C | T | T | C | A | A | G | a | A | G | A | C | C | T | G | G | T | G | G | ACACCGGTGGTGCAGAAGAACTTCAG | 167. | AAAACTGAAGTTCTTCTGCACCACCG | 361. |
| A | C | T | T | C | A | A | G | A | t | G | A | C | C | T | G | G | T | G | G | ACACCGGTGGTGCAGTTGAACTTCAG | 168. | AAAACTGAAGTTCAACTGCACCACCG | 362. |
| A | C | T | T | C | A | A | G | A | A | c | A | C | C | T | G | G | T | G | G | ACACCGGTGGTGCACATGAACTTCAG | 169. | AAAACTGAAGTTCATGTGCACCACCG | 363. |
| A | C | T | T | C | A | A | G | A | A | G | t | C | C | T | G | G | T | G | G | ACACCGGTGGTGGAGATGAACTTCAG | 170. | AAAACTGAAGTTCATCTCCACCACCG | 364. |
| A | C | T | T | C | A | A | G | A | A | G | A | g | C | T | G | G | T | G | G | ACACCGGTGGTGGAGATGAACTTCAG | 171. | AAAACTGAAGTTCATCTCCACCACCG | 365. |
| A | C | T | T | C | A | A | G | A | A | G | A | C | c | T | G | G | T | G | G | ACACCGGTGGTCCAGATGAACTTCAG | 172. | AAAACTGAAGTTCATCTGGACCACCG | 366. |

TABLE A-continued

| gRNA Target Sequence Position | | | | | | | | | | | | | | | | | | | | | Oligos for generating gRNA expression plasmid | | | | |
|---|---|---|---|---|---|---|---|---|---|---|---|---|---|---|---|---|---|---|---|---|---|---|---|---|
| 1 | 2 | 3 | 4 | 5 | 6 | 7 | 8 | 9 | 10 | 11 | 12 | 13 | 14 | 15 | 16 | 17 | 18 | 19 | 20 | oligonucleotide 1 (5' to 3') | # | oligonucleotide 2 (5' to 3') | # |
| A | C | T | T | C | A | A | G | T | A | G | A | C | G | a | G | G | T | G | G | ACACCGGTGGAGCAGATGAACTTCAG | 173. | AAAACTGAAGTTCATCTGCTCCACCG | 367. |
| A | C | T | T | C | A | A | G | T | A | G | A | C | G | T | G | c | T | G | G | ACACCGGTGCAGATGAATGAACTTCAG | 174. | AAAACTGAAGTTCATCTGCAGACCG | 368. |
| A | C | T | T | C | A | A | G | T | A | G | A | C | G | T | G | c | T | G | G | ACACCGGTCGTGCAGATGAATGAACTTCAG | 175. | AAAACTGAAGTTCATCTGCACGACCG | 369. |
| A | C | T | T | C | A | A | G | T | A | G | A | C | G | T | G | G | T | G | G | ACACCGGAGGTGCAGATGAATGAACTTCAG | 176. | AAAACTGAAGTTCATCTGCACCTCCG | 370. |
| A | C | T | T | C | A | A | G | T | A | G | A | C | G | T | G | G | T | G | G | ACACCGCTGGTGCAGATGAATGAACTTCAG | 177. | AAAACTGAAGTTCATCTGCACCAGCG | 371. |
| t | g | a | T | C | A | A | G | T | A | G | A | C | G | T | G | G | T | G | G | ACACCGGTGGTGCAGATGAATGAACTTGTG | 178. | AAAACACAAGTTCATCTGCACCACCG | 372. |
| A | C | T | T | C | A | A | G | T | A | G | A | C | G | T | G | G | T | G | G | ACACCGGTGGTGCAGATGAATGAACAACAG | 179. | AAAACTGTTGTTCATCTGCACCACCG | 373. |
| A | C | T | T | C | A | A | G | T | A | G | A | C | G | T | G | G | T | G | G | ACACCGGTGGTGCAGATGATGTTCAG | 180. | AAAACTGAACATCATCTGCACCACCG | 374. |
| A | C | T | T | C | A | A | G | T | A | G | A | C | G | T | G | G | T | G | G | ACACCGGTGGTGCAGATCTACTTCAG | 181. | AAAACTGAAGTAGATCTGCACCACCG | 375. |
| A | C | T | T | C | A | A | G | T | A | G | A | C | G | T | G | G | T | G | G | ACACCGGTGGTGCTCATCAACTTCAG | 182. | AAAACTGAAGTTGATGAGCACCACCG | 376. |
| A | C | T | T | C | A | A | G | T | A | G | A | C | G | T | G | G | T | G | G | ACACCGGTGGTCGAGATGAACTTCAG | 183. | AAAACTGAAGTTCATCTCGACCACCG | 377. |
| A | C | T | T | C | A | A | G | T | A | G | A | C | G | T | G | G | T | G | G | ACACCGGTCGTGCAGATGAATGAACTTCAG | 184. | AAAACTGAAGTTCATCTGCTGCACCG | 378. |
| A | C | T | T | C | A | A | G | T | A | G | A | C | G | T | G | G | T | G | G | ACACCGGTGGACGTGCAGATGAACTTCAG | 185. | AAAACTGAAGTTCATCTGCACGTCCG | 379. |
| A | C | T | T | C | A | A | G | T | A | G | A | C | G | T | G | G | T | G | G | ACACCGGTGGAGTGCAGATGAACTTCAG | 186. | AAAACTGAAGTTCATCTGCACTCCG | 380. |
| A | C | T | T | C | A | A | G | T | A | G | A | C | G | T | G | G | T | G | G | ACACCGGTGGTGCAGATGAACTTCAG | 187. | AAAACTGAAGTTCATCTGCACCAGGG | 381. |
| A | C | T | T | C | A | A | G | T | A | G | A | C | G | T | G | G | T | G | G | ACACCGGTGGTGCAGATGAACTTCAG | 188. | AAAACTGAAGTTCATCTGCACGTGCG | 382. |
| A | C | T | T | C | A | A | G | T | A | G | A | C | G | T | G | G | T | G | G | ACACCGCACCTGGTGCAGATGAACTTCAG | 189. | AAAACTGAAGTTCATCTGCAGGTGCG | 383. |
| A | C | T | T | C | A | A | G | T | A | G | A | C | G | T | G | G | T | G | G | ACACCGCACCAGGTGCAGATGAACTTCAG | 190. | AAAACTGAAGTTCATCTGGTGGTGCG | 384. |
| A | C | T | T | C | A | A | G | T | A | G | A | C | G | T | G | G | T | G | G | ACACCGCACCACGGTGCAGATGAACTTCAG | 191. | AAAACTGAAGTTCATCTCGTGGTGCG | 385. |
| A | C | T | T | C | A | A | G | T | A | G | A | C | G | T | G | G | T | G | G | ACACCGCACCACGGTGCAGATGAACTTCAG | 192. | AAAACTGAAGTTCATCTCGTGTGCG | 386. |
| A | C | T | T | C | A | A | G | T | A | G | A | C | G | T | G | G | T | G | G | ACACCGCACCACCAGTGATGAACTTCAG | 193. | AAAACTGAAGTTCATCACGTGGTGCG | 387. |
| A | C | T | T | C | A | A | G | T | A | G | A | C | G | T | G | G | T | G | G | ACACCGGTGGTGCAGTCATGAACTACTG | 194. | AAAACAGTAGTTCATGACTGCACCACCG | 388. |
| t | g | a | T | C | A | A | G | T | A | G | A | C | G | T | G | G | T | G | G | ACACCGGTGGTGCAGATGACATGAACTACAG | 195. | AAAACTGTAGTTCATC TABLE A-continued

| | | | | | | | | | gRNA Target Sequence Position | | | | | | | | | | | Oligos for generating gRNA expression plasmid | | | |
|---|---|---|---|---|---|---|---|---|---|---|---|---|---|---|---|---|---|---|---|---|---|---|---|
| 20 | 19 | 18 | 17 | 16 | 15 | 14 | 13 | 12 | 11 | 10 | 9 | 8 | 7 | 6 | 5 | 4 | 3 | 2 | 1 | # | oligonucleotide 1 (5' to 3') | # | oligonucleotide 2 (5' to 3') |

Endogenous Target 1 (VEGFA Site 1)

| G | G | G | T | G | G | G | G | G | G | A | G | T | T | T | G | C | T | C | C | 219. 220. | ACACCGGGTGGGGGGAGTTTGCTCCG | 413. 414. | AAAACGGAGCAAACTCCCCCCACCCG |

Endogenous Target 2 (VEGFA Site 2):

| G | A | C | C | C | C | C | T | C | C | A | C | C | C | C | G | C | C | T | C | 221. 222. | ACACCGACCCCCTCCACCCCGCCTCG | 415. 416. | AAAACGAGGCGGGGTGGAGGGGGTCG |

Endogenous Target 3 (VEGFA Site 3):

| G | G | T | G | A | G | T | G | A | G | T | G | T | G | T | G | C | G | T | G | 223. 224. | ACACCGGTGAGTGAGTGTGTGCGTGG | 417. 418. | AAAACCACGCACACACTCACTCACCG |

Endogenous Target 4 (EMX1):

| G | A | G | T | C | C | G | A | G | C | A | G | A | A | G | A | A | G | A | A | 225. 226. | ACACCGAGTCCGAGCAGAAGAAGAAG | 419. 420. | AAAACTTCTTCTTCTGCTCGGACTCG |

Endogenous Target 5 (RNF2):

| G | T | C | A | T | C | T | T | A | G | T | C | A | T | T | A | C | C | T | G | 227. 228. | ACACCGTCATCTTAGTCATTACCTGG | 421. 422. | AAAACCAGGTAATGACTAAGATGACG |

Endogenous Target 6 (FANCF):

| G | G | A | A | T | C | C | C | T | T | C | T | G | C | A | G | C | A | C | C | 229. | ACACCGGAATCCCTTCTGCAGCACCG | 423. | AAAACGGTGCTGCAGAAGGGATTCCG |

Sequences of oligonucleotides used to generate expression plasmids encoding single gRNAs/variant single gRNAs targets to sites in the EGFP reporter gene and single gRNAs targets to six endogenous human gene targets. #, SEQ ID NO:.

EGFP Activity Assays

U2OS.EGFP cells harboring a single integrated copy of an EGFP-PEST fusion gene were cultured as previously described (Reyon et al., Nat Biotech 30, 460-465 (2012)). For transfections, 200,000 cells were Nucleofected with the indicated amounts of sgRNA expression plasmid and pJDS246 together with 30 ng of a Td-tomato-encoding plasmid using the SE Cell Line 4D-Nucleofector™ X Kit (Lonza) according to the manufacturer's protocol. Cells were analyzed 2 days post-transfection using a BD LSRII flow cytometer. Transfections for optimizing gRNA/Cas9 plasmid concentration were performed in triplicate and all other transfections were performed in duplicate.

PCR Amplification and Sequence Verification of Endogenous Human Genomic Sites

PCR reactions were performed using Phusion Hot Start II high-fidelity DNA polymerase (NEB) with PCR primers and conditions listed in Table B. Most loci amplified successfully using touchdown PCR (98° C., 10 s; 72-62° C., −1° C./cycle, 15 s; 72° C., 30 s]10 cycles, [98° C., 10 s; 62° C., 15 s; 72° C., 30 s]25 cycles). PCR for the remaining targets were performed with 35 cycles at a constant annealing temperature of 68° C. or 72° C. and 3% DMSO or 1M betaine, if necessary. PCR products were analyzed on a QIAXCEL capillary electrophoresis system to verify both size and purity. Validated products were treated with ExoSap-IT (Affymetrix) and sequenced by the Sanger method (MGH DNA Sequencing Core) to verify each target site.

TABLE B

| Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|
| | TCCAGATGGCACATTGTCAG | | AGGGAGCAGGAAAGTGAGGT | 436. | DMSO | 0 | 0 | 1 |
| | GGGGCCCACTCTTCTTCCAT | | ACCCAGACTCCTGGTGTGGC | 437. | DMSO | 2 | 0 | 0 |
| | GCTAAGCAGAGATGCCTATGCC | | ACCACCCTTTCCCCAGAAA | 438. | DMSO | 0 | 0 | 2 |
| | ACCCCACAGCCAGGTTTTCA | | GAATCACTGCACCTGGCCATC | 439. | DMSO | 0 | 0 | 0 |
| | TGGGCAACTTCAGACAACC | | TAAAGGCGTGCTGGGAGAG | 440. | DMSO | 1 | 1 | 0 |
| | GCATGTCAGGATCTGACCCC | | TGCAGGGCCATCTTGTGT | 441. | DMSO | 0 | 2 | 0 |
| | CCACCACATGTTCTGGGTGC | | CTGGGTCTGTTCCCTGTGG | 442. | DMSO | 1 | 1 | 1 |
| | GGCTCTCCCTGCCCTAGTTT | | GCAGGTCAAGTTGGAACCG | 443. | DMSO | 0 | 2 | 1 |
| | GGGGCTGAGAACACATGAGATGCA | | AGATTTGTGCACTGCCTGCCT | 444. | DMSO | 1 | 0 | 2 |
| | CCCGACCTCCGCTCCAAAGC | | GGACCTCTGCACACCCTGGC | 445. | DMSO | 2 | 1 | 0 |
| | TGCAAGGTCGCATAGTCCCA | | CAGGAGGGGAAGTGTGTCC | 446. | DMSO | 1 | 1 | 1 |
| | GCCCATTCTTTTTGCAGTGAA | | GAGAGCAAGTTTGTTCCCCAGG | 447. | DMSO | 0 | 1 | 2 |
| | GCCCCAGCCCCTCTGTTTC | | CTGCTGGTAGGGGAGCTGG | 448. | DMSO | 0 | 2 | 0 |
| | CGGCTGCCTTCCCTGAGTCC | | GGGTGACGCTTGCCATGAGC | 449. | DMSO | 1 | 2 | 0 |
| | TGACCCTGGAGTACAAAATGTTCCA | | GCTGAGACAACCAGCCCCAGCT | 450. | 72 C Anneal, 3% DMSO | 2 | 1 | 0 |
| | TGCCTCCACCCTTAGCCCT | | GCAGCCGATCCACACTGGGG | 451. | DMSO | 1 | 0 | 2 |
| | AACTCAGGACAACACTGCCTGT | | CCCAGGAGCAGGGTACAATGC | 452. | DMSO | 0 | 1 | 2 |
| | TCCTCCTTGGAGAGGGGCCC | | CCTTGGAAGGGGCCTTGGTGG | 453. | DMSO | 0 | 3 | 0 |
| | CCGAGGGCATGGGCAATCCT | | GGCTGCTGCGAGTTGCCAAC | 454. | DMSO | 0 | 1 | 3 |
| | TGCTTTGCATGGGGTCTCAGACA | | GGGTTGCTTGCCCTCTGTGT | 455. | DMSO | 0 | 2 | 2 |
| | AGCTCCTTCTCATTTCTTCCTCTGCTGT | | CACAGAAGGATGTGTGCAGGTT | 456. | DMSO | 0 | 2 | 2 |
| | AGCAGACACAGGTGAATGCTGCT | | GGTCAGGTGTGCTGCTAGGCA | 457. | DMSO | 1 | 1 | 2 |
| | CCTGTGGGCTCTCAGGTGC | | ACTGCCTGCCAAAGTGGGTGT | 458. | No DMSO TD | 1 | 1 | 2 |
| | AGCTGCACTGGGGAATGAGT | | TGCCGGGTAATAGCTGGCTT | 459. | DMSO | 0 | 1 | 3 |
| | CCAGCCTGGGCAACAAAGCG | | GGGGGCTTCCAGGTCACAGG | 460. | 72 C Anneal, 3% DMSO, 6% DMSO | 0 | 3 | 1 |
| | TACCCCCACTGCCCCATTGC | | ACAGGTCCATGCTTAGCAGAGGG | 461. | DMSO | 0 | 1 | 3 |
| | ACGGATTCACGACGGAGGTGC | | CCGAGTCCGTGGCAGAGAGC | 462. | DMSO | 0/1 | 2 | 2 |
| GGGTGATTGAAGTTTGCTCCAGG GGGTGATTGAAGTTTGCTCCAGG (SEQ ID NO: 424) | | | | | | | | |
| | TGTGGTTGAAGTAGGGGACAGGT | | TGGCCCAATTGGAAGTGATTTCGT | 463. | DMSO | 3 | 1 | 0 |
| | TGGGATGGCAGAGTCATCAACGT | | GGCCCAATGCGTAGAGGATGCA | 464. | DMSO | 0 | 3 | 1 |
| | ATGGGGCGCTCCAGTCTGTG | | TGCACCCACACAGCCAGCAA | 465. | DMSO | 0 | 3 | 1 |
| | GGGGAGGAGGACCAGGGAA | | AATTAGCTGGGCGCGGTGGT | 466. | 72 C Anneal, 3% DMSO | 0 | 1 | 3 |
| | ATCCCGTGCAGGAAGTCGCC | | CAGGCGGCCCCTTGAGGAAT | 467. | DMSO | 3 | 1 | 0 |
| | CCCAACCCTTTGCTCAGCG | | TGACGAGAACACCACAGGCAGA | 468. | DMSO | 1 | 2 | 1 |
| | ATCGACGAGGAGGGGGCCTT | | CCCCTCACTCAAGCAGGCCC | 469. | DMSO | 0 | 3 | 1 |
| | TGCTCAAGGGGCCTGTTCCA | | TGCCGGTCAGTGCAGGAGTC | 470. | No DMSO | 1 | 0 | 0 |
| | TGCCTGGCACGCAGTAGGTG | | GGGAAGGGGAACAGGGTGCA | 471. | DMSO | 0 | 1 | 5 |
| | Not optimized | | | | | 1 | 1 | 3 |

TABLE B-continued

| Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|
| | ACCTGGGCTTGCCACTAGGG | 472. | GCTGCTCGCAGTTAAGCACCA | 784. | DMSO | 1 | 3 | 1 |
| | GTGGCCGGGCTACTGCTACC | 473. | GGTTCCACAAGCTGGGGGCA | 785. | DMSO | 3 | 2 | 0 |
| | Not optimized | | | | | 1 | 3 | 1 |
| | GCAAGAGGCGGAGGAGACCC | 474. | AGAGTCATCCATTTCCTGGGGC | 786. | DMSO | 2 | 3 | 0 |
| | GGGGTCAGTGGTGATATCCCCCT | 475. | AGGGAATCCTTTTTCCATTGCTTGTTT | 787. | 1M betaine, TD | 1 | 4 | 0 |
| | AGAGAGGCCACGTGGAGGGT | 476. | GCCTCCCCTCCTCCTTCCCA | 788. | DMSO | 1 | 3 | 1 |
| | GACAGTGCCTTGCGATGCAC | 477. | TCTGACCGGTATGCCTGACG | 789. | DMSO | 3 | 2 | 0 |
| | TGTGTGAAACGCAGCCTGGCT | 478. | CCGTTCTAGTACTTCCTCCAGCCTT | 790. | DMSO | 3 | 1 | 1 |
| | GGTTCTCCCTTGCCTCCTGTGA | 479. | CCCACTGCTCCTAGCCCTGC | 791. | DMSO | 1 | 3 | 1 |
| | TGAAGTCAACAATCTAAGCTTCCACCT | 480. | AGCTTTGGTAGTTGGAGTCTTTGAAGG | 792. | DMSO | 3 | 1 | 2 |
| | TGATTGGGCTGCAGTTCATGTACA | 481. | GCACAGCCTGCCTTGGAAG | 793. | DMSO | 2 | 1 | 3 |
| | TCCATGGGCCCTCTGAAAGA | 482. | AGGGCTTCGTCTGCGA | 794. | DMSO | 1 | 1 | 5 |
| | GCGGTTGGTGGGTTTGATGC | 483. | GAGTTCCTCCTCCGCCAGT | 795. | DMSO | 2 | 0 | 4 |
| | AGGCAAGATTTTCCAGTGTGCAAGA | 484. | GCTTTTGCCTGGGACTCCGC | 796. | DMSO | 2 | 0 | 4 |
| | GCTCGCTGGTCGGGCTCTCTG | 485. | GCTCGTCCCACTTCCTCCCTGG | 797. | No DMSO TD | 3 | 1 | 2 |
| | GCTGCGAGGCTTCCGTGAGA | 486. | CGCCCCTAGAGCTAAGGGGGT | 798. | DMSO | 3 | 2 | 1 |
| | CCAGGAGCCTGAGAGCTGCC | 487. | AGGGCTAGGACTGCAGTGAGC | 799. | DMSO | 1 | 3 | 2 |
| | CTGTGCTCAGCCTGGGTGCT | 488. | GCCTGGGGCTGTGAGTAGTTT | 800. | DMSO | 2 | 3 | 1 |
| | AGCTCGCGCCAGATCTGTGG | 489. | ACTTGGCAGGCTGAGGCAGG | 801. | 72 C Anneal, 3% DMSO | 4 | 2 | 0 |
| | AGAGAAGTCGAGGAAGAGAGAG | 490. | CAGCAGAAAGTTCATGTTTCG | 802. | DMSO | 0 | 0 | 2 |
| | TGGACAGCTGCAGTACTCCCTG | 491. | ACTGATCGATGATGGCCTATGGGT | 803. | DMSO | 1 | 0 | 1 |
| | CAAGATGTGCACTTGGGCTA | 492. | GCAGCCTATTGTCTCCTGGT | 804. | DMSO | 1 | 1 | 1 |
| | GTCCAGTGCCTGACCCTGGC | 493. | AGCATCATGCCCACCAGCTTCA | 805. | DMSO | 1 | 0 | 0 |
| | GCTCCCGATCCTCTGCCACC | 494. | GTGCGTGTCCGTTCACCCT | 806. | DMSO | 1 | 2 | 0 |
| | GGGGACAGGCAGGCAAGGAG | 495. | CGTGATTCGAGTTCCTGGCA | 807. | DMSO | 1 | 1 | 1 |
| | AAGGGGCTGCTGGGTAGGAC | 496. | CTGCGAGATGCCCAAATCG | 808. | DMSO | 2 | 1 | 0 |
| | GACCCTCAGGAAGCTGGGAG | 497. | | 809. | 1M betaine, TD | 1 | 0 | 2 |
| | CCGCGCGCTCTGCTAGA | 498. | TGCTGGGATTACAGGCGCGA | 810. | DMSO | 1 | 1 | 1 |
| | CCAGGTGGTGTCAGCGGAGG | 499. | TGCCTGGCCCTCTCTGAGTCT | 811. | DMSO | 0 | 2 | 1 |
| | CGACTCCACGGCGTCTCAGG | 500. | CAGCGCAGTCCAGCCCGATG | 812. | 1M betaine, TD | 2 | 1 | 0 |
| | CTTCCCTCCCCCAGCACCAC | 501. | GCTACAGGTTGCACAGTGAGAGGT | 813. | DMSO | 1 | | 1 |
| | CCCCGGGAGTCTGTCCTGA | 502. | CCCAGCCGTTCCAGGTCTTCC | 814. | DMSO | 1 | 1 | 2 |
| | GAAGCGGAAAACCCGGCTC | 503. | TCCAGGGTCCTTCTCGGCCC | 815. | DMSO | 1 | 0 | 2 |
| | AGGGTGGTCAGGGAGGCCTT | 504. | CATGGGCTCGGACCTCGTC | 816. | DMSO | 2 | 0 | 1 |
| | GGGAAGAGGGCAGGGCTGTCG | 505. | TGCCAGGAAGGAAAGCTGGCC | 817. | 72 C Anneal, 3% DMSO | 0 | 2 | 1 |
| | GAGTGACGATGAGCCCCGGG | 506. | CCCTTAGCTGCAGTCGCCC | 818. | 68 C Anneal, 3% DMSO | 0 | 1 | 3 |
| | CCCATGAGGGGTTTGAGTGC | 507. | TGAAGATGGGCAGTTTGGGG | 819. | DMSO | 0 | 2 | 2 |
| | CACCTGGGGCATCTGGGTGG | 508. | ACTGGGGTTGGGGAGGGGAT | 820. | DMSO | 2 | 0 | 2 |
| | TCATGATCCCCAAAAGGGCT | 509. | CCATTTGTGTCTGATCTGTGGT | 821. | DMSO | 1 | 0 | 3 |
| | TGGTTGCCCAGAATAGTTGGCCA | 510. | AGGAAAATGTGTTGTGCCAGGCC | 822. | DMSO | 1 | 2 | 1 |
| | GCCTCAGAGCAACCCTGCCC | 511. | GCCAAGTTACTCATCAAGAAAGTTGG | 823. | No DMSO TD | 2 | 1 | 1 |

TABLE B-continued

| Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|
| CTCTCCCCCACCCCCCCTCTGG (SEQ ID NO: 425) | GCCGGGACAAGACTGAGTTGGG | | TCCCGAACTCCCGCAAAACG | 512. | DMSO | 1 | 2 | 1 |
| | TGCTGCAGGTGGTTCCGGAG | | CTGGAACCGCATCCTCCGCA | 513. | No DMSO TD | 1 | 0 | 3 |
| | ACACTGGTCCAGGTCCCGTCT | | GGCTGTGCCTTCCGATGGAA | 514. | DMSO | 2 | 1 | 1 |
| | ATCGCGCCAAAGCACAGGT | | AGGCTTCTGGAAAGTCCTCAATGCA | 515. | DMSO | 3 | 0 | 2 |
| | Not optimized | | | | | | | |
| | CCCTCATGGTGGTCTTACGGCA | | AGCCACACATCTTTCTGGTAGGG | 516. | DMSO | 1 | 1 | 2 |
| | TGCGTCGCTCATGCTGGGAG | | AGGGTGGGTGTACTGGCTCA | 517. | DMSO | 0 | 3 | 2 |
| | GAGCTGAGACGGCACCACTG | | TGGCCTTGAACTCTTGGGCT | 518. | 1M betaine, TD | 0 | 1 | 1 |
| | Not optimized | | | | | | | |
| | AGTGAGAGTGGCACGAACCA | | CAGTAGGTGGTCCCTTCCGC | 519. | DMSO | 1 | 2 | 1 |
| | Not optimized | | | | | | | |
| | GGGAGAACCTTGTCAGCCT | | AAGCCGAAAAGCTGGGCAAA | 520. | DMSO | 2 | 1 | 1 |
| | CTTCCAGTGTGGCCCGTCC | | ACACAGTCAGAGCTCCGCG | 521. | DMSO | 0 | 2 | 3 |
| | Not optimized | | | | | | | |
| | CTGAGAGGGGAGGGGGAGG | | TCGACTGGTCTTGTCCTCCA | 522. | 68 C Anneal, 3% DMSO | 3 | 0 | 4 |
| | CAGCCTGCTGCATCGGAAAA | | TGCAGCCAAGAGAAAAAGCCT | 523. | 1M betaine, TD | 1 | 0 | 4 |
| | TCCCTCTGACCCGGAACCCA | | ACCCGACTTCTCCTCCCATTGC | 524. | DMSO | 2 | 1 | 2 |
| | TGGGGTTGCGTGCTTGTCA | | GCCAGGAGGACACCAGGACC | 525. | DMSO | 4 | 1 | 0 |
| | ATCAGGTGCCAGGAGGACAC | | GGCCTGAGAGTGGAGAGTGG | 526. | DMSO | 4 | 0 | 0 |
| | Not optimized | | | | | | | |
| | TGAGCCACATGAATGAATCAAGGCCTCC | | ACCTCTCCAAGTCCAGTAACTCTCT | 527. | DMSO | 1 | 4 | 0 |
| | GGTCCCTCTGTGCAGTGAA | | CTTTGGTGACCTGCACAG | 528. | DMSO | 1 | 3 | 1 |
| | GCGAGGCTGCTGACTTCCT | | GCTGGGACTACAGACATGTGCCA | 529. | DMSO | 2 | 2 | 2 |
| ATTTCCTCCCCCCCCCTCAGG (SEQ ID NO: 426) | ATTGCAGGCGTGTCCAGGCA | | AAATCCTGCATGGTGATGGGAGT | 530. | DMSO | 1 | 1 | 5 |
| | TGCTCTGCCATTTATGTCCTATGAACT | | ACAGCCTCTTCTCCATGACTGAGC | 531. | DMSO | 1 | 3 | 2 |
| | TCCGCCAAACAGGAGGCAG | | GCGGTGGGGAAGCCATTGAG | 532. | DMSO | 2 | 3 | 1 |
| | GGGGGTCTGGCTCACCTGA | | CCTGTCGGGAGAGTGCCTGC | 533. | DMSO | 3 | 1 | 2 |
| | TCCTGGTTCATTTGCTAGAACTCTGA | | ACTTCCAGATGCAACCAGGGCT | 534. | DMSO | 3 | 2 | 1 |
| | CGTGTGGTGAGCCTGAGTCT | | GCTTCACCGTAGAGGCTGCT | 535. | DMSO | 3 | 0 | 3 |
| | AGGCCCTGATAATTCATGCTACCAA | | TCAGTGACAACCTTTTGTATTCGGCA | 536. | DMSO | 0 | 2 | 4 |
| | Not optimized | 537. | | | | 2 | 2 | 2 |
| | TCCAGAATGGCACATTGTCAG | | AGGGAGCAGGAAAAGTGAGGT | 538. | DMSO | 1 | 0 | |
| | GCAAGGCACGTGTCAAGGGT | | CACCGACACACCACCTCACC | 539. | DMSO | 0 | 0 | 1 |
| | GAGGGGAAGTCACGACAA | | TACCCGGGCCGTCTGTTAGA | 540. | DMSO | 0 | 0 | 2 |
| | GACACCCCACACACTCTCATGC | | TGAATCCCTTCACCCCAAG | 541. | DMSO | 1 | 0 | 1 |
| | TCCTTTGAGGTTCATCCCC | | CCAATCCAGGATGATTCGC | 542. | DMSO | 1 | 0 | 0 |
| | CAGGGCAGGAACACAGGAA | | CGGAGGTATGTGCGGAGTG | 543. | DMSO | 1 | 1 | 1 |
| | TGCAGCCTGAGTGAGCAAGTGT | | GCCCAGGTGCTAAGCCCTC | 544. | DMSO | 1 | 0 | 1 |
| | TACAGCCTGGGTGATGGAGC | | TGTGTCATGGACTTTCCCATTGT | 545. | 1M betaine, TD | 1 | 1 | 0 |
| | GGCAGGCATTAAACTCATCAGGTCC | | TCTCCCCAAGGTATCAGAGAGCT | 546. | DMSO | 1 | 1 | 0 |
| | GGGCCTCCCTGCTGGTTCTC | | GCTGCCGTCCGAACCCAAGA | 547. | DMSO | 0 | 1 | 1 |

TABLE B-continued

| Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|
| | ACAAACGCAGGTGACCGAA | 548. | ACTCCGAAAATGCCCGCAGT | 860. | DMSO | 1 | 1 | 0 |
| | AGGGGAGGGGACATTGCCT | 549. | TTGAGAGGGTTCAGTGGTTGC | 861. | DMSO | 1 | 0 | 1 |
| | CTAATGCTTACGGCTGCGGG | 550. | AGCCAACGGCAGATGCAAAT | 862. | DMSO | 1 | 0 | 1 |
| | GAGCGAAGTTAACCCACCGC | 551. | CACACATGCACATGCCCCTG | 863. | 68 C, 3% DMSO | 2 | 0 | 0 |
| | GCATGTGTCTAACTGGAGACAATAGCA | 552. | TCCCCCATATCAACACACACA | 864. | DMSO | 2 | 0 | 0 |
| | GCCCCTCCCGCCTTTTGTGT | 553. | TGGGCAAAGGACATGAAACAGACA | 865. | DMSO | 2 | 0 | 0 |
| | GCCTCAGCTCTGCTCTTAAGCCC | 554. | ACGAACAGATCATTTTCATGGCTTCC | 866. | DMSO | 2 | 0 | 0 |
| | CTCCAGAGCCTGGCCTACCA | 555. | CCCTCTCCGGAAGTGCCTTG | 867. | DMSO | 0 | 1 | 1 |
| | TCTGTCACCACACAGTTACCACC | 556. | GTTGCTGGGGATGGGGTAT | 868. | DMSO | 0 | 1 | 1 |
| | GGGGACCCTCAAGAGGCACT | 557. | GGGCATCAAAGGATGGGGAT | 869. | DMSO | 2 | 0 | 1 |
| | TGTGGAGGGTGGGACCTGGT | 558. | ACAGTTAGGTGCGGTCTTTGGG | 870. | DMSO | 1 | 0 | 2 |
| | CGGGGTGGCAGTGACGTCAA | 559. | GGTGCAGTCCAAGAGCCCC | 871. | DMSO | 0 | 0 | 3 |
| | AGCTGAGGCAGAGTCCCCGA | 560. | GGGAGACAGAGCAGCGCTC | 872. | DMSO | 1 | 1 | 1 |
| | ACCACCAGACCCCACCTCCA | 561. | AGGACGACTTGTGCCCCATTCA | 873. | 72 C Anneal, 3% DMSO | 1 | 1 | |
| | GGGTCAGGACGCAGGTCAGA | 562. | TCCACCACCCACCCATCCT | 874. | 72 C Anneal, 3% DMSO | 2 | 0 | 1 |
| | ACACTCTGGGCTAGGTGCTGAA | 563. | GCCCCCTCACCACATGATGCT | 875. | DMSO | 2 | 0 | 1 |
| | GGGGCCATTCCTCTGCTGCA | 564. | TGGGGATCCTTGCTCATGGC | 876. | DMSO | 3 | 0 | 0 |
| | ACACACTGGCTCGCATTCACCA | 565. | CCTGACGAGGCCAGGTGTT | 877. | DMSO | 2 | 1 | 0 |
| | TGGGCACGTAGTAAACTGCACCA | 566. | CTCGCCGCCGTGACTGTAGG | 878. | DMSO | 0 | 3 | 1 |
| | TCAGCTGGTCCTGGGCTTGG | 567. | AGAGCACTGGGTAGCAGTCAGT | 879. | DMSO | 2 | 1 | 0 |
| | AGACACAGCCAGGGCCTCAG | 568. | GGTGGGCGTGTGTGTGTACC | 880. | 68 C, 3% DMSO | 1 | 1 | 1 |
| | ACACTCTCACACGCACCAA | 569. | GAGAAGTCAGGGCTTCAGGCGGG | 881. | 72 C Anneal, 3% DMSO | 1 | 2 | 0 |
| | ACTGCCTGCATTTCCCCGGT | 570. | TGGTGAGGGCTTCAGGGAGC | 882. | DMSO | 1 | 1 | 1 |
| | GCCAGGTTCATTGACTGCCC | 571. | TCCTTCTACACATCGGCGGC | 883. | DMSO | 2 | 1 | 0 |
| | CAGGGAGCCGAGTTCGTAA | 572. | CCTGACCTGGGGCTCTGGTAC | 884. | DMSO | 2 | 1 | 0 |
| | TCCTCGGGAAGTCATGGCTTCA | 573. | GCACTGAGCAACCAGGAGCAC | 885. | DMSO | 2 | 1 | 0 |
| | Not optimized | | | | | | | 3 |
| | TAAACCGTTGCCCCGCCTC | 574. | GCTCCCCTGCCAGGTGAACC | 886. | DMSO | 2 | 1 | 1 |
| | CCTGCTGAGACTCCAGGTCC | 575. | CTGCGAGTGGCTGGCTATA | 887. | DMSO | 2 | 1 | 2 |
| | CTCGGGGACTGACAAGCCG | 576. | GGAGCAGCTCTTCCAGGGCC | 888. | DMSO | 3 | 0 | 1 |
| | CCCCGACCAAAGCAGGAGCA | 577. | CTGGCAGCCTCTGGATGGGG | 889. | DMSO | 2 | 2 | 1 |
| | Not optimized | | | | | 0 | 3 | 1 |
| | ATTTCAGAGCCCGGGGAAA | 578. | AGGGCGCGGTGTTATGGTTA | 890. | DMSO | 1 | 2 | 1 |
| | GCCAGTGGCTTAGTGTCTTTGTGT | 579. | TGACATATTTTCCTGGGCCATGGGT | 891. | DMSO | 2 | 2 | 1 |
| | TGCCAGAAGAACATGGGCAGA | 580. | CCATGCTGACATCATATACTGGGAAGC | 892. | DMSO | 3 | 1 | 1 |
| | GCGTGTCTCTGTGTGCGTGC | 581. | CCAGGCTGGGCACACAGGTT | 893. | DMSO | 3 | 1 | 0 |
| | Not optimized | | | | | 1 | 2 | 0 |
| | TGCCCAGTCCAATATTTCAGCAGCT | 582. | AGGATGAGTTCATGTCCTTTGTGGGG | 894. | DMSO | 2 | 2 | 0 |
| | GGGTGAAAATTTGGTACTGTTAGCTGT | 583. | AATGACTCATTCCCTGGGTATCTCCCA | 895. | DMSO | 2 | 2 | 0 |
| | TGCCCCATCAATCACCTCGGC | 584. | CAAGGTCGGCAGGGCAGTGA | 896. | DMSO | 1 | 2 | 2 |
| | GCCTCCTCTGCCCGCTGGTAA | 585. | TGAGAGGTTCCTGTTGCTCCACACT | 897. | DMSO | 2 | 2 | 1 |
| | Not optimized | | | | | 2 | 0 | |
| | GCCACCAAAATAGCCAGCGT | 586. | ACATGCATCTGTGTGCGT | 898. | DMSO | 3 | 0 | 2 |

TABLE B-continued

| Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|
| | ACAGACTGACCCTTGAAAAATACCAGT | | TGTATCTTCTTGCCAATGGTTTTCCC | 587. | DMSO | 2 | 1 | 2 |
| | AGCCAAATTTCTCAACAGCAGCACT | | TCCTGGAGAGCAGGCATTTTTGT | 588. | DMSO | 3 | 1 | 1 |
| | ACCTCCTTGTCGCTGCCTGGC | | GGCGGGAAGGTAACCTGGG | 589. | DMSO | 2 | 1 | 2 |
| | CACAAAGCTCTACCTTTCCAGTAGTGT | | TGATCCGATGGTTGTTCACAGCT | 590. | DMSO | 3 | 1 | 1 |
| | TGTGGGGATTACCTGCCTGGC | | ACGCACAAAAATGCCCTTGTCA | 591. | DMSO | 2 | 2 | 0 |
| | TGAGCAGACCAGTCATCCAGC | | GCCCGAGCACCAGTGTAGGGC | 592. | DMSO | 2 | 3 | 3 |
| | ATTAGCTGGGCGTTGGCGGAG | | ACTGCATCCATCTCAGGCAGCT | 593. | DMSO | 2 | 1 | 2 |
| | TGAAGCAGAAGGAGTGGAGAAGGA | | TCAGCTTCACATCTGTTTCAGTTCAGT | 594. | DMSO | 4 | 0 | 2 |
| | TGGTGGAGTGTGTGTGTGGT | | TGCACAGAAAGAGAGTGCCCA | 595. | DMSO | 1 | 3 | 2 |
| | GCCCTGTACGTCCTGACAGC | | TGCACAGCCACTTAGCCTCTCT | 596. | DMSO | 3 | 1 | 2 |
| | AGCGCAGGTAAACAGGCCCA | | TCTCTCGCCCGTTTCCTTGT | 597. | DMSO | 3 | 3 | 1 |
| | ATGGGTGCCAGGTACCACGC | | ACAGCAGGAAGGAGCCGCAG | 598. | DMSO | 2 | 3 | 3 |
| | CGGGCGGGTGGACAGATGAG | | AGGAGGTCGAGCCAGGGG | 599. | DMSO | 1 | 3 | 1 |
| | TCAACCTAGTGAACACAGACCACTGA | | GTCTATATACAGCCACAACCTCATGT | 600. | DMSO | 2 | 2 | 3 |
| | GCCAGGGCCAGTGGATTGCT | | TGTCATTTCTTAGTATGTCAGCCGGA | 601. | DMSO | 1 | 4 | 0 |
| | GAGCCCCACCGGTTCAGTCC | | GCCAGAGCTACCCACTCGCC | 602. | DMSO | 1 | 3 | 2 |
| | Not optimized | | | 603. | | | | |
| | GGAGCAGCTGGTCAGAGGGG | | GGGAAGGGGACACTGGGGA | 604. | DMSO | | | |
| | TCTCTCCTTCAACTCATGACCAGCT | | ATCTGCACATGTATGTACAGGAGTCAT | 605. | DMSO | 0 | 1 | 1 |
| AAGACAGAGAGGAGAAGAAGAAGGG (SEQ ID NO: 427) | TGGGAATCTCCAAAGAACCCCC | | AGGGTGACTGTGGGAACTTTGCA | 606. | DMSO | 2 | 1 | 1 |
| | GATGCGCCCACTGAGCACGT | | ACTTCGTAGAGCCTTAAACATGTGGC | 607. | DMSO | 1 | 0 | 2 |
| | AGGATTAATGTTTAAAGTCACTGGTGG | | TCAAACAAGGTGCAGATACAGCA | 608. | 1M betaine, TD | 1 | 0 | 2 |
| | TCCAAGCCACTGGTTTCTCAGTCA | | TGCTCTGTGGATCATATTTTGGGGGA | 609. | DMSO | 0 | 1 | 2 |
| | ACTTTCAGAGCTTGGGGCAGGT | | CCCACGCTGAAGTGCAATGGC | 610. | DMSO | 0 | 2 | 1 |
| | CAAAGCATGCCTTTCAGCCG | | GGCTCTTCGATTTGGCACCT | 611. | 1M betaine, TD | 1 | 2 | 1 |
| | GGACTCCCTGCAGCTCCAGC | | AGGAACACAGGCCAGGCTGG | 612. | 72 C Anneal, 6% DMSO | 1 | 0 | 2 |
| | CCCTTTAGGCACCTTCCCCA | | CCGACCTTCATCCCTCCTGG | 613. | DMSO | 0 | 1 | 3 |
| | TGATTCTGCCTTAGAGTCCCAGGT | | TGGGCTCTGTGTCCCTACCCA | 614. | DMSO | 2 | 3 | 0 |
| | Not optimized | | | | | | | |
| | AGGCAGGAGGAGCAAGCAGGT | | ACCCTGACTACTGACTGACCGCT | 615. | DMSO | 0 | 1 | 0 |
| | CTCCCCATTGCGACCCGAGG | | AGAGGCATTGACTTGGAGCACCT | 616. | DMSO | 1 | 2 | 0 |
| | CTGGAGCCCAGCAGGAAGGC | | CCTCAGGGAGGGGGCTGAT | 617. | DMSO | 1 | 2 | 0 |
| | ACTGTGGGCGTTGTCCCAC | | AGGTCGGCAGGGTTTAAGGA | 618. | DMSO | 1 | 0 | 0 |
| | GGCGCTCCCTTTTCCCTTTGT | | CAGTCCCATGTCTCGTGGA | 619. | DMSO | 2 | 0 | 3 |
| | TGCCATCTATAGCAGCCCCT | | GCATCTTGCTAACCGTACTTCTTCTGA | 620. | DMSO | 1 | 2 | 3 |
| | GTGGAGACGCTAAACTGTGAGGT | | GCTCCTGGCCTCTTCCTACAGC | 621. | DMSO | 1 | 0 | 1 |
| | CCGAACTTCTGCTGAGCTTGATGC | | CCAAGTCAATGGGCAACAAGGGA | 622. | DMSO | 0 | 2 | 2 |
| | Not optimized | | | | | | | |
| | TGCCCCCAAGACCTTTCTC | | ATGGCAGGCAGGAGGAAG | 623. | DMSO | 2 | 1 | 2 |
| | GGGTGGGGCCATTGTGGGTT | | CTGGGGCCAGGGTTTCTGCC | 624. | DMSO | 3 | 0 | 2 |
| | TGGAGAACATGGAGAGGCTTGCAA | | TCCTTCTGTAGGCAATGGGAACAA | 625. | DMSO | 3 | 0 | 1 |
| | GCCACATGGTAGAAGTCGGC | | GGCAGATTTCCCCATGCTG | 626. | 1M betaine, TD | 1 | 2 | 1 |

TABLE B-continued

| Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|
| | GTGTACACCCCAAGTCCTCC | | AAGGGGAGTGTGCAAGCCTC | 627. | DMSO | 3 | 1 | 0 |
| | AGGTCTGGCTAGAGATGCAGCA | | AGTCCAACACTCAGGTGAGACCCT | 628. | DMSO | 3 | 1 | 0 |
| | CCAAGAGGACCCAGCTGTTGGA | | GGGTATGGAATTCTGATTAGCAGAGC | 629. | DMSO | 0 | 2 | 2 |
| | ACCATCTCTTCATTGATGAGTCCCAA | | ACACTGTGAGTATGCTTGGCGT | 630. | DMSO | 2 | 2 | 0 |
| | GGCTGCGGGAGATGAGCTC | | TCGGATGCTTTTCCACAGGCT | 631. | DMSO | 2 | 2 | 1 |
| | TCTTCCAGGAGGGCAGCTC | | CCAATCCTGAGCTCCTACAAGCT | 632. | DMSO | 1 | 0 | 4 |
| | GAGCTGCACTGGATGGCACT | | TGCTTGGTTAAGGGGTGTTTTGA | 633. | DMSO | 1 | 1 | 3 |
| | TCTGGGAAGGTGAGGAGGCCA | | TGGGGACAATGGAAAGCAATGA | 634. | DMSO | 0 | 2 | 3 |
| | CTTGCTCCAGCCTGACCC | | AGCCCTTGCCATGCAGGACC | 635. | DMSO | 3 | 2 | 1 |
| | GGGGATTTTTATCTGTTGGGTGCGAA | | AACCACAGATGTACCCTCAAAGCT | 636. | DMSO | 3 | 2 | 1 |
| | ACCCATCAGGACCGCAGCAC | | TCTGAACCTGGGAGGCGGA | 637. | 72 C Anneal, 3% DMSO | 3 | 1 | 1 |
| | CGTCCCTCACGCCAGCCTC | | CCTTCCTGGGCCTGGGGTTC | 638. | DMSO | 1 | 3 | 1 |
| | CCCTCGCAAGGTGGAGTCTCC | | AGATGTTCTGTCCCCAGGCCT | 639. | DMSO | 1 | 1 | 1 |
| | GGCTTCCACTGCTGAAGGCCT | | TGCCGCTCACATACCCTCC | 640. | DMSO | 2 | 3 | 2 |
| | AGCAATTGCCTGTCGGGTGATGT | | AGCACCTATTGGACACTGGTTCTCT | 641. | DMSO | 1 | 1 | 1 |
| | TCTAGAGCAGGGGCACAATGC | | TGGAGATGGAGCCTGGTGGGA | 642. | DMSO | 2 | 3 | 2 |
| | GGTCTCAGAAAATGGAGAGAAAGCACG | | CCCACAGAAACCTGGGCCT | 643. | DMSO | 2 | 2 | 4 |
| | GGTTGCTGATACCAAAACGTTTGCT | | TGGGTCTCTCACCTCTGCA | 644. | DMSO | 1 | 2 | 3 |
| | ACTCTCCTTAAGTACTGATATGGCTGT | | CAGAATCTTGCTCTGTTGCCCA | 645. | DMSO | 0 | 3 | 2 |
| | Not optimized | | | | | 0 | 4 | 2 |
| | Not optimized | | | | | 2 | 2 | 2 |
| | CAATGCCTGCAGTCCTCAGGA | | TCCCAAGAGAAAACTCTGTCCTGACA | 646. | DMSO | 2 | 2 | 2 |
| | GCAATTGGCTGCCCAGGGAAA | | TGGCTGTGCTGGGCTGTGTT | 647. | DMSO | 4 | 1 | 1 |
| | CCACAAGCCTCAGCCTACCCG | | ACAGGTGCCAAAACACTGCCT | 648. | DMSO | 2 | 2 | 2 |
| | GCCTCTTGCAAATGAGAACTCCTTTT | | CGATCAGTCCCCTGGCGTCC | 649. | DMSO | 2/1 | 2/3 | 3 |
| TCATTGCAGCAGAAGAAGAAAGG TCATTGTAGCAGAAGAGAAAAGG (SEQ ID NO: 428) | TCCCAGAAATCTGCCTCCCGCA | 650. 651. | AGGGGTTTCCAGGCACATGGG | | DMSO | 0 | 4 | 2 |
| GGTATCTAAGTCATTACCTGTGG GGTATCTAAGTCAATACCTGTGG (SEQ ID NO: 429) | TCCTAAAATCAGTTTTGAGATTTACTTCC | 652. | AAAGTGTTAGCAACATACAGAAGTCAGGA | | DMSO | 1/2 | 1 | 1 |
| | ACGATCTTGCTTCATTTCCCTGTACA | 653. | TGTCTGAGTATCTAGGCTAAAAGTGGT | | 72 C Anneal, 3% DMSO | | | |
| | ACGATCTTGCTTCATTTCCCTGTACA | 654. | AGTGCTTTGTTGAACTGAAAAGCAAACA | | DMSO | 0 | 3 | 0 |
| | GCACCTTGGTGTCTGCTAAATGCC | 655. | GGGCAACTGAACAGGCATGAATGG | | DMSO | 1 | 2 | 0 |
| | AACTGTCCTGCATCCCCGCC | 656. | GGTGCACCTGGATCCACCCA | | DMSO | 1 | 1 | 1 |
| | Not optimized | | | | | 1 | 1 | 1 |
| | CATCACCCTCCACCAGGCCC | 657. | ACCACTGCTGCAGGCTCCAG | | DMSO | 0 | 3 | 0 |
| | Not optimized | | | | | 2 | 0 | 2 |
| | CCTGACCCGTGGTTCCCGAC | 658. | TGGTGCGTGGTGTGTGTGGT | | 72 C Anneal, 3% DMSO | 1 | 2 | 1 |
| | TGGGAACATTGGAGAAGTTTCCTGA | 659. | CCATGTGACTACTGGGCTGCCC | | DMSO | 1 | 1 | 2 |
| | AGCCTTGGCAAGCAACTCCCT | 660. | GGTTCTCTCTCAGAAAAGAAAAGAGG | | DMSO | 1 | 0 | 3 |
| | GCAGCGGACTTCAGAGCA | 661. | GCCAGAGGCTCTCAGCAGTGC | | DMSO | 1 | 0 | 3 |
| | CCAGCCTGGTCAATATGGCA | 662. | ACTGTGCCCAGCCCCATATT | | DMSO | 2 | 1 | 1 |
| | ATGCCAACACTCGAGGGGCC | 663. | CGGGTTGTGGCACCGGGTTA | | DMSO | 2 | 1 | 1 |

TABLE B-continued

| Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|
| | TTGCTCTAGTGCGGAGGGGG | | AGAGTTCAGGCATGAAAAGCAACA | 664. | DMSO | 3 | 0 | 1 |
| | AGCTGAAGATAGCAGTGTTAAGCCT | | TGCAATTTGAGGGGCTCTTCA | 665. | DMSO | 1 | 1 | 2 |
| | AGTCACTGGAGTAAGCCTGCCT | | TGCCAGCCAAAAGTTGTTAGTGTGT | 666. | DMSO | 2 | 0 | 2 |
| | GGGTCTCCCTCAGTGCCCTG | | TGTGTGGTAGGGAGCAAAACGACA | 667. | DMSO | 2 | 0 | 2 |
| | TGGGGGCTGTTAAGAGGCACA | | TGACCACACACCCCACG | 668. | DMSO | 1 | 2 | 1 |
| | TCAAAACAGATTGACAAGGCCAAAT | | TGTGTTTTAAGCTGCACCCCAGG | 669. | DMSO | 1 | 0 | 3 |
| | TCTGGCACCAGGACTGATTGTACA | | GCACGCAGCTGACTCCCAGA | 670. | DMSO | 1 | 2 | 1 |
| | Not optimized | | | | | | | |
| | AGCATCTGTGATACCCTACCTGTCT | | ACCAGGGCTGCCACAGAGTC | 671. | DMSO | 1 | 0 | 3 |
| | TAGTCTGTTGCCCAGGCTG | | CTCGGCCCCTGAGAGTTCAT | 672. | DMSO | 1 | 2 | 1 |
| TCCATCTCACTCATTACCTGAGG TCCATCTCACTCATTACCTGATG (SEQ ID NO: 430) | CTGCAACCAGGGCCCTTACC | | GAGCAGCAGCAAAGCCACCG | 673. | DMSO | 1 | 1 | 2 |
| | GCCTGAGAGCAAGCCTGGG | | AGCCGAGACAATCTGCCCCG | 674. | DMSO | 1 | 1 | 2 |
| TTTATATTAGTGATTACCTGCGG (SEQ ID NO: 431) | AGTGAAACAAACAAGCAGCAGTCTGA | | GGCAGGTCTGACCAGTGGGG | 675. | No DMSO TD | 1 | 2 | 1 |
| | AGGCTCAGAGAGGTAAGCAATGGA | | TGAGTAGACAGAAATGTTACCGGTGTT | 676. | DMSO | 3 | 0 | 2 |
| | TCAGAGATGTTAAAGCCTTGGTGG | | AGTGAACAAGGAATGGGGGA | 677. | DMSO | 3 | 0 | 2 |
| | TGTGCTTTCTGGGGTAGTGGCA | | CACCTCAGCCTGTAGTCCTGG | 678. | DMSO | 0 | 4 | 1 |
| | CCATTGGGTGACTGAATGCACA | | GCCACTGTCCCCAGCCTATT | 679. | DMSO | 1 | 3 | 1 |
| | ACCAAGAAAGTGAAAGGAAACCC | | TGAGATGGCATACGATTTACCCA | 680. | DMSO | 1 | 2 | 2 |
| | AGGGTGGGACTGAAAGGAGCT | | TGGCATCACTCAGAGATTGGAACACA | 681. | DMSO | 3 | 1 | 1 |
| | ACCAGTGCTGTGTGACCTTGGA | | TCCTATGGGAGGGAGGCTTCT | 682. | DMSO | 3 | 1 | 1 |
| | CCAGGTGTGGTGGTTCATGAC | | GCATACGGCAGTAGAATGAGCC | 683. | DMSO | 4 | 0 | 1 |
| | CAGGCGCTGGGTTCTTAGCCT | | CCTTCCTGGGCCCCATGGTG | 684. | DMSO | 2 | 3 | 0 |
| | TGGGGTCCAAGATGTCCCCT | | TGAAACTGCTTGATGAGGTGTGA | 685. | DMSO | 1 | 2 | 2 |
| | GCTGGGCTTGGGTGGTATATGC | | ACTTGCAAAGCTGATAACTGACTGA | 686. | DMSO | 5 | 0 | 1 |
| | AGTTGGTGTCACTGACAATGGA | | CGCAGGCGCACGAGTTCATCA | 687. | DMSO | 3 | 0 | 3 |
| | AGAGGAGGCACAATTCAACCCT | | GGCTGGGGAGGCCTCACAAT | 688. | DMSO | 1 | 1 | 4 |
| | GGGAAAGTTTGGGAAAGTCAGGA | | AGGACAAGCTACCCCACC | 689. | DMSO | 1 | 3 | 2 |
| | TGGTGCATCAAAGGGTTGCTTCT | | TCATTCCAGCACGCGGGAG | 690. | DMSO | 0 | 3 | 3 |
| | CCCAGGCTGCCCATCACACT | | TGGTAAGTATACCTTGGGGACCT | 691. | DMSO | 1 | 3 | 2 |
| | TCAGTGCCCCTGGGTCCTCA | | TGTGCAAATACTGACACGGTGC | 692. | DMSO | 4 | 2 | 0 |
| | AGCACTCCCTTTGAATTTTGGTGCT | | ACTGAAGTCCAGCTCTTCCATTTCA | 693. | DMSO | 2 | 1 | 3 |
| | GAAACCGGTCCCTGGTGCA | | GGGGAGTAGAGGGTAGTGTGTGCC | 694. | DMSO | 2 | 0 | 4 |
| | TTGCGGGTCCCTGTGGAGTC | | AGGTGCCGTGTGTGTGCCCAA | 695. | DMSO | 1 | 2 | 3 |
| | | | | 696. | DMSO | | | |
| | GCCCTACACATTCTGCTCTCCCTCCA | | GGGCCCGGGAAAGAGTTGCTG | 697. | DMSO | | | |
| | TTGGAGTGTGGCCCGGGTTG | | ACCTCTCTTTTCTCTGCCTCACTGT | 698. | DMSO | 0 | 1 | 1 |
| | CACACCATTGCTGATCCAGGC | | GCAGTACGAAGCACGAAGC | 699. | DMSO | 0 | 1 | 1 |
| | CTCCAGGGCTCGCTGTTCCC | | CTCGGCCTCTGCTGTTCCC | 700. | DMSO | 1 | 2 | 2 |
| | CTGTGGTAGCCGTTGCCAGG | | CCCCATACCACCTCTCCGGA | 701. | DMSO | 0 | 2 | 1 |
| | GGTGGCGGGACTTGAATGAG | | CCAGCGTGTTTCCAAGGGAT | 702. | 1M betaine, TD | 0 | 1 | 2 |

TABLE B-continued

| Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|
| GGAATCCCCTCTCCAGCCCTGG GGAATCCCCTCTCCAGCCTCTGG (SEQ ID NO: 432) | CCAGAGGTGGGGCCCTGTGA | 703. | TTTCCACACTCAGTTCTGCAGGA | 1014. | DMSO | 1 | 1 | 1/2 |
| GGAATCTCTTCCTTGGCATCTGG (SEQ ID NO: 433) | TGTGACTGGTTGTCCTGCTTTCCT | 704. | GCAGTGTTTTGTGGTGATGGGCA | 1015. | 1M betaine, TD | | | 5 |
| | CTGGCCAAGGGGTGAGTGGG | | TGGGACCCCAGCAGCCAATG | 1016. | DMSO | 1 | 0 | 2 |
| | ACGGTGTGCTGGCTGCTCTT | | ACAGTGCTGACCGTGCTGGG | 1017. | DMSO | 1 | 1 | 1 |
| | TGGTTTGGGCCTCAGGGATGG | | TGCCTCCCACACAAAATGTCTACCT | 1018. | DMSO | 0 | 0 | 3 |
| | TGGTTTGGGCCTCAGGGATGG | | ACCCCTTATCCCAGAACCATGA | 1019. | DMSO | 0 | 0 | 3 |
| | TCCAAGTCAGCGATGAGGGCT | | TGGGAGCTGTTCCTTTTTGCCA | 1020. | DMSO | 0 | 3 | 0 |
| | CACCCCTCCAGCTTCCCAA | | GCTAGAGGGTCTGCTGCCTT | 1021. | DMSO | 1 | 2 | 0 |
| | AGACCCCTTGGCCAAGCACA | | CTTGCTCTCACCCCGCCTC | 1022. | DMSO | 2 | 1 | 0 |
| | ACATGTGGGAGGCGGACAGA | | TCTCACTTTGCTGTTACCGATGTCG | 1023. | DMSO | 0 | 1 | 3 |
| | GGACGACTGTGCCTGGGACA | | AGTGCCCAGAGTGTTGTAACTGCT | 1024. | 72 C Anneal, 3% DMSO | 0 | 1 | 3 |
| | GGAGAGCTCAGCGCCAGGTC | | CAGCGGTGGCCCGTGGGAATA | 1025. | DMSO | 1 | 1 | 2 |
| | GCTGAAGTGCTCTGGGGTGCT | | ACCCCACTGTGGATGAATTGGTACC | 1026. | DMSO | 0 | 1 | 2 |
| | TGGGGTGCACATGGCCATC | | TTGCCTGCAGGGGAAGCAG | 1027. | DMSO | 0 | 1 | 3 |
| | CTCGTGGGAGGCCAACACCT | | AGCCACCAACACATACCAGGCT | 1028. | DMSO | 2 | 0 | 2 |
| | GCATGCCTTTAATCCCGGCT | | AGGATTTCAGAGTGATGGGGCT | 1029. | DMSO | 2 | 1 | 1 |
| | GCCCAGCCACAAAGTGCAT | | GCAAATTTCTGCACCTACTCTAGGCCT | 1030. | DMSO | 1 | 1 | 2 |
| | AGCTCACAAGAATTGGAGGTAACAGT | | GCAGTCACCCTTCACTGCCTGT | 1031. | DMSO | 1 | 1 | 2 |
| | AAACTGGGCTGGGCTTCCGG | | GGGGCTAAGGCATTGTCAGACCC | 1032. | DMSO | 2 | 0 | 2 |
| | GCAGGTAGGCAGTCTGGGGC | | TCTCCTGCCTCAGCCTCCCA | 1033. | DMSO | 1 | 2 | 1 |
| | GCAGGTAGGCAGTCTGGGGC | | TCTCCTGCCTCAGCCTCCCA | 1034. | 1M betaine, TD | 1 | 2 | 1 |
| | GCAGGTAGGCAGTCTGGGGC | | TCTCCTGCCTCAGCCTCCCA | 1035. | 1M betaine, TD | 1 | 2 | 1 |
| | GCTCTGGGTAGAAGGAGGC | | GGCCTGTCAACCAACCAACC | 1036. | DMSO | 2 | 2 | 0 |
| | TGACATGTTGTGTGCTGGGC | | AAATCCTGCAGCCTCCCTT | 1037. | DMSO | 0 | 2 | 2 |
| | TCCTGGTGAGATCGTCCACAGGA | | TCCTCCCCACTCAGCCTCCC | 1038. | DMSO | 0 | 3 | 1 |
| | TCCTAATCCAAGTCCTTTGTTCAGACA | | AGGGACCAGCCACTACCCTTCA | 1039. | DMSO | 2 | 2 | 0 |
| | GGGACACCAGTTCCTTCCAT | | GGGGGAGATTAGGAGTTCCCC | 1040. | DMSO | 1 | 0 | 4 |
| | ACACCACTATCAAGGCAGAGTAGGT | | TCTGCCTGGGGTGCTTTCCC | 1041. | DMSO | 1 | 1 | 3 |
| | CTGGGAGCGCGGAGGGAAGTGC | | GCCCCGACAGATGAGGCCTC | 1042. | DMSO | 1 | 2 | 2 |

TABLE B-continued

| Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|
| CAGATTACTCTGCAGCACCGGG (SEQ ID NO: 434) | CGGGTCTCGGAATGCCTCCA | 732. | ACCCAGGAATTGCCACCCCC | 1043. | DMSO | 1 | 2 | 3 |
| | TTGCTGTGGTCCCGGTGGTG | 733. | GCAGACACTAGAGCCCGCCC | 1044. | DMSO | 3 | 2 | 0 |
| | GGTGTGGTGACAGGTCGGGT | 734. | ACCTGCGTCTCTGTGCTGCA | 1045. | DMSO | 2 | 3 | 0 |
| | CTCCAGGACAGTGCTCGGC | 735. | CCTGGCCCCATGCTGCCTG | 1046. | DMSO | 2 | 2 | 1 |
| | TGCGTAGGTTTTGCCTCTGTGA | 736. | AGGGAATGATGTTTTCCACCCCT | 1047. | DMSO | 2 | 3 | 0 |
| | CTCCGCAGCCACCGTTGGTA | 737. | TGCATTGACGTACGATGGCTCA | 1048. | DMSO | 1 | 3 | 1 |
| | ACCTGCAGCATGAACTCTCGCA | 738. | ACCTGAGCAACATGACTCACCTGG | 1049. | DMSO | 2 | 1 | 2 |
| ACACAAACTTCTGCAGCACCTGG ACACAAACTTCTGCAGCACGTGG (SEQ ID NO: 435) | TCTCCAGTTCTTGCTCTCATGG | 739. | ACCATTGGTGAACCCAGTCA | 1050. | 1M betaine, TD | 3/2 | 3 | 1 |
| | TGGGGTTGGTGGTCTTGAATCCA | 740. | TCAGCTATAACCTGGGACTTGTGCT | 1051. | DMSO | 2 | 1 | 3 |
| | AGCAGCCAGTCCAGTGTCCTG | 741. | CCCTTTCATCGAGAACCCAGGG | 1052. | DMSO | 3 | 1 | 2 |
| | TGGACGCTGCTGGGAGGAGA | 742. | GAGGTCTCGGGCTGCTCGTG | 1053. | DMSO | 0 | 3 | 3 |
| | AGGTTTGCACTCTGTTGCCTGG | 743. | TGGGGTGATTGGTTGCCAGGT | 1054. | DMSO | 3 | 2 | 1 |
| | TCTTCCTTTGCCAGGCAGCACA | 744. | TGCAGGAATAGCAGGTATGAGGAGT | 1055. | DMSO | 4 | 0 | 2 |
| | GGACGCCTACTGCCTGGACC | 745. | GCCCTGGCAGCCCATGGTAC | 1056. | DMSO | 3 | 0 | 3 |
| | AGGCAGTCATCGCCTTGCTA | 746. | GGTCCCACCTTCCCCTACAA | 1057. | DMSO | 2 | 3 | 1 |
| | Not optimized | | | | | | 1 | 2 |
| | CCCCAGCCCCCACCAGTTTC | 747. | CAGCCCCAGGCCACAGCTTCA | 1058. | DMSO | 1 | 4 | 1 |

Sequences and characteristics of genomic on- and off-target sites for six RGNs targeted to endogenous human genes and primers and PCR conditions used to amplify these sites.

Determination of RGN-Induced on- and Off-Target Mutation Frequencies in Human Cells For U2OS.EGFP and K562 cells, $2\times10^5$ cells were transfected with 250 ng of gRNA expression plasmid or an empty U6 promoter plasmid (for negative controls), 750 ng of Cas9 expression plasmid, and 30 ng of td-Tomato expression plasmid using the 4D Nucleofector System according to the manufacturer's instructions (Lonza). For HEK293 cells, $1.65\times10^5$ cells were transfected with 125 ng of gRNA expression plasmid or an empty U6 promoter plasmid (for the negative control), 375 ng of Cas9 expression plasmid, and 30 ng of a td-Tomato expression plasmid using Lipofectamine LTX reagent according to the manufacturer's instructions (Life Technologies). Genomic DNA was harvested from transfected U2OS.EGFP, HEK293, or K562 cells using the QIAamp DNA Blood Mini Kit (QIAGEN), according to the manufacturer's instructions. To generate enough genomic DNA to amplify the off-target candidate sites, DNA from three Nucleofections (for U2OS.EGFP cells), two Nucleofections (for K562 cells), or two Lipofectamine LTX transfections was pooled together before performing T7EI. This was done twice for each condition tested, thereby generating duplicate pools of genomic DNA representing a total of four or six individual transfections. PCR was then performed using these genomic DNAs as templates as described above and purified using Ampure XP beads (Agencourt) according to the manufacturer's instructions. T7EI assays were performed as previously described (Reyon et al., 2012, supra).

DNA Sequencing of NHEJ-Mediated Indel Mutations

Purified PCR products used for the T7EI assay were cloned into Zero Blunt TOPO vector (Life Technologies) and plasmid DNAs were isolated using an alkaline lysis miniprep method by the MGH DNA Automation Core. Plasmids were sequenced using an M13 forward primer (5'-GTAAAACGACGGCCAG-3' (SEQ ID NO:1059) by the Sanger method (MGH DNA Sequencing Core).

Example 1a. Single Nucleotide Mismatches

To begin to define the specificity determinants of RGNs in human cells, a large-scale test was performed to assess the effects of systematically mismatching various positions within multiple gRNA/target DNA interfaces. To do this, a quantitative human cell-based enhanced green fluorescent protein (EGFP) disruption assay previously described (see Methods above and Reyon et al., 2012, supra) that enables rapid quantitation of targeted nuclease activities (FIG. 2B) was used. In this assay, the activities of nucleases targeted to a single integrated EGFP reporter gene can be quantified by assessing loss of fluorescence signal in human U2OS.EGFP cells caused by inactivating frameshift insertion/deletion (indel) mutations introduced by error prone non-homologous end joining (NHEJ) repair of nuclease-induced double-stranded breaks (DSBs) (FIG. 2B). For the studies described here, three ~100 nt single gRNAs targeted to different sequences within EGFP were used, as follows:

```
                                          (SEQ ID NO: 9)
    EGFP Site 1 GGGCACGGGCAGCTTGCCGGTGG (SEQ ID NO: 10)
    EGFP Site 2 GATGCCGTTCTTCTGCTTGTCGG (SEQ ID NO: 11)
    EGFP Site 3 GGTGGTGCAGATGAACTTCAGGG
```

Each of these gRNAs can efficiently direct Cas9-mediated disruption of EGFP expression (see Example 1e and 2a, and FIGS. 3E (top) and 3F (top)).

In initial experiments, the effects of single nucleotide mismatches at 19 of 20 nucleotides in the complementary targeting region of three EGFP-targeted gRNAs were tested. To do this, variant gRNAs were generated for each of the three target sites harboring Watson-Crick transversion mismatches at positions 1 through 19 (numbered 1 to 20 in the 3' to 5' direction; see FIG. 1) and the abilities of these various gRNAs to direct Cas9-mediated EGFP disruption in human cells tested (variant gRNAs bearing a substitution at position 20 were not generated because this nucleotide is part of the U6 promoter sequence and therefore must remain a guanine to avoid affecting expression.)

For EGFP target site #2, single mismatches in positions 1-10 of the gRNA have dramatic effects on associated Cas9 activity (FIG. 2C, middle panel), consistent with previous studies that suggest mismatches at the 5' end of gRNAs are better tolerated than those at the 3' end (Jiang et al., Nat Biotechnol 31, 233-239 (2013); Cong et al., Science 339, 819-823 (2013); Jinek et al., Science 337, 816-821 (2012)). However, with EGFP target sites #1 and #3, single mismatches at all but a few positions in the gRNA appear to be well tolerated, even within the 3' end of the sequence. Furthermore, the specific positions that were sensitive to mismatch differed for these two targets (FIG. 2C, compare top and bottom panels)—for example, target site #1 was particularly sensitive to a mismatch at position 2 whereas target site #3 was most sensitive to mismatches at positions 1 and 8.

Example 1b. Multiple Mismatches

To test the effects of more than one mismatch at the gRNA/DNA interface, a series of variant gRNAs bearing double Watson-Crick transversion mismatches in adjacent and separated positions were created and the abilities of these gRNAs to direct Cas9 nuclease activity were tested in human cells using the EGFP disruption assay. All three target sites generally showed greater sensitivity to double alterations in which one or both mismatches occur within the 3' half of the gRNA targeting region. However, the magnitude of these effects exhibited site-specific variation, with target site #2 showing the greatest sensitivity to these double mismatches and target site #1 generally showing the least. To test the number of adjacent mismatches that can be tolerated, variant gRNAs were constructed bearing increasing numbers of mismatched positions ranging from positions 19 to 15 in the 5' end of the gRNA targeting region (where single and double mismatches appeared to be better tolerated).

Testing of these increasingly mismatched gRNAs revealed that for all three target sites, the introduction of three or more adjacent mismatches results in significant loss of RGN activity. A sudden drop off in activity occurred for three different EGFP-targeted gRNAs as one makes progressive mismatches starting from position 19 in the 5' end and adding more mismatches moving toward the 3' end. Specifically, gRNAs containing mismatches at positions 19 and 19+18 show essentially full activity whereas those with mismatches at positions 19+18+17, 19+18+17+16, and 19+18+17+16+15 show essentially no difference relative to a negative control (FIG. 2F). (Note that we did not mismatch position 20 in these variant gRNAs because this position needs to remain as a G because it is part of the U6 promoter that drives expression of the gRNA.)

Additional proof of that shortening gRNA complementarity might lead to RGNs with greater specificities was obtained in the following experiment: for four different EGFP-targeted gRNAs (FIG. 2H), introduction of a double mismatch at positions 18 and 19 did not significantly impact activity. However, introduction of another double mismatch at positions 10 and 11 then into these gRNAs results in near complete loss of activity. Interestingly introduction of only the 10/11 double mismatches does not generally have as great an impact on activity.

Taken together, these results in human cells confirm that the activities of RGNs can be more sensitive to mismatches in the 3' half of the gRNA targeting sequence. However, the data also clearly reveal that the specificity of RGNs is complex and target site-dependent, with single and double mismatches often well tolerated even when one or more mismatches occur in the 3' half of the gRNA targeting region. Furthermore, these data also suggest that not all mismatches in the 5' half of the gRNA/DNA interface are necessarily well tolerated.

In addition, these results strongly suggest that gRNAs bearing shorter regions of complementarity (specifically ~17 nts) will be more specific in their activities. We note that 17 nts of specificity combined with the 2 nts of specificity conferred by the PAM sequence results in specification of a 19 bp sequence, one of sufficient length to be unique in large complex genomes such as those found in human cells.

Example 1c. Off-Target Mutations

To determine whether off-target mutations for RGNs targeted to endogenous human genes could be identified, six single gRNAs that target three different sites in the VEGFA gene, one in the EMX1 gene, one in the RNF2 gene, and one in the FANCF gene were used (Table 1 and Table A). These six gRNAs efficiently directed Cas9-mediated indels at their respective endogenous loci in human U2OS.EGFP cells as detected by T7 Endonuclease I (T7EI) assay (Methods above and Table 1). For each of these six RGNs, we then examined dozens of potential off-target sites (ranging in number from 46 to as many as 64) for evidence of nuclease-induced NHEJ-mediated indel mutations in U2OS.EGFP cells. The loci assessed included all genomic sites that differ by one or two nucleotides as well as subsets of genomic sites that differ by three to six nucleotides and with a bias toward those that had one or more of these mismatches in the 5' half of the gRNA targeting sequence (Table B). Using the T7EI assay, four off-target sites (out of 53 candidate sites examined) for VEGFA site 1, twelve (out of 46 examined) for VEGFA site 2, seven (out of 64 examined) for VEGFA site 3 and one (out of 46 examined) for the EMX1 site (Table 1 and Table B) were readily identified. No off-target mutations were detected among the 43 and 50 potential sites examined for the RNF2 or FANCF genes, respectively (Table B). The rates of mutation at verified off-target sites were very high, ranging from 5.6% to 125% (mean of 40%) of the rate observed at the intended target site (Table 1). These bona fide off-targets included sequences with mismatches in the 3' end of the target site and with as many as a total of five mismatches, with most off-target sites occurring within protein coding genes (Table 1). DNA sequencing of a subset of off-target sites provided additional molecular confirmation that indel mutations occur at the expected RGN cleavage site (FIGS. 8A-C).

TABLE 1

On- and off-target mutations induced by RGNs designed to endogenous human genes

| Target | Site name | Sequence | SEQ ID NO: | Indel Mutation Frequency (%) ± SEM | | | Gene |
|---|---|---|---|---|---|---|---|
| | | | | U2OS.EGFP | HEK293 | K562 | |
| Target 1 (VEGFA Site 1) | T1 | GGGTGGGGGGAGTTTGCTCCTGG | 1059. | 26.0 ± 2.9 | 10.5 ± 0.07 | 3.33 ± 0.42 | VEGFA |
| | OT1-3 | GGATGGAGGGAGTTTGCTCCTGG | 1060. | 25.7 ± 9.1 | 18.9 ± 0.77 | 2.93 ± 0.04 | IGDCC3 |
| | OT1-4 | GGGAGGGTGGAGTTTGCTCCTGG | 1061. | 9.2 ± 0.8 | 8.32 ± 0.51 | N.D. | LOC116437 |
| | OT1-6 | CGGGGGAGGGAGTTTGCTCCTGG | 1062. | 5.3 ± 0.2 | 3.67 ± 0.09 | N.D. | CACNA2D |
| | OT1-11 | GGGGAGGGGAAGTTTGCTCCTGG | 1063. | 17.1 ± 4.7 | 8.54 ± 0.16 | N.D. | |
| Target 2 (VEGFA Site 2) | T2 | GACCCCCTCCACCCCGCCTCCGG | 1064. | 50.2 ± 4.9 | 38.6 ± 1.92 | 15.0 ± 0.25 | VEGFA |
| | OT2-1 | GACCCCCCCCACCCCGCCTCCGG | 1065. | 14.4 ± 3.4 | 33.6 ± 1.17 | 4.10 ± 0.05 | FMN1 |
| | OT2-2 | GGGCCCCTCCACCCCGCCTCTGG | 1066. | 20.0 ± 6.2 | 15.6 ± 0.30 | 3.00 ± 0.06 | PAX6 |
| | OT2-6 | CTACCCCTCCACCCCGCCTCCGG | 1067. | 8.2 ± 1.4 | 15.0 ± 0.64 | 5.24 ± 0.22 | PAPD7 |
| | OT2-9 | GCCCCCACCCACCCCGCCTCTGG | 1068. | 50.7 ± 5.6 | 30.7 ± 1.44 | 7.05 ± 0.48 | LAMA5 |
| | OT2-15 | TACCCCCCACACCCCGCCTCTGG | 1069. | 9.7 ± 4.5 | 6.97 ± 0.10 | 1.34 ± 0.15 | SPNS3 |
| | OT2-17 | ACACCCCCCCACCCCGCCTCAGG | 1070. | 14.0 ± 2.8 | 12.3 ± 0.45 | 1.80 ± 0.03 | |
| | O12-19 | ATTCCCCCCCACCCCGCCTCAGG | 1071. | 17.0 ± 3.3 | 19.4 ± 1.35 | N.D. | HDLBP |
| | OT2-20 | CCCCACCCCCACCCCGCCTCAGG | 1072. | 6.1 ± 1.3 | N.D. | N.D. | ABLIM1 |
| | OT2-23 | CGCCCTCCCCACCCCGCCTCCGG | 1073. | 44.4 ± 6.7 | 28.7 ± 1.15 | 4.18 ± 0.37 | CALY |
| | OT2-24 | CTCCCCACCCACCCCGCCTCAGG | 1074. | 62.8 ± 5.0 | 29.8 ± 1.08 | 21.1 ± 1.68 | |
| | OT2-29 | TGCCCCTCCCACCCCGCCTCTGG | 1075. | 13.8 ± 5.2 | N.D. | N.D. | ACLY |
| | OT2-34 | AGGCCCCCACACCCCGCCTCAGG | 1076. | 2.8 ± 1.5 | N.D. | N.D. | |
| Target 3 (VEGFA Site 3) | T3 | GGTGAGTGAGTGTGTGCGTGTGG | 1077. | 49.4 ± 3.8 | 35.7 ± 1.26 | 27.9 ± 0.52 | VEGFA |
| | OT3-1 | GGTGAGTGAGTGTGTGTGTGAGG | 1078. | 7.4 ± 3.4 | 8.97 ± 0.80 | N.D. | (abParts) |
| | OT3-2 | AGTGAGTGAGTGTGTGTGTGGGG | 1079. | 24.3 ± 9.2 | 23.9 ± 0.08 | 8.9 ± 0.16 | MAX |
| | OT3-4 | GCTGAGTGAGTGTATGCGTGTGG | 1080. | 20.9 ± 11.8 | 11.2 ± 0.23 | N.D. | |
| | OT3-9 | GGTGAGTGAGTGCGTGCGGGTGG | 1081. | 3.2 ± 0.3 | 2.34 ± 0.21 | N.D. | TPCN2 |
| | OT3-17 | GTTGAGTGAATGTGTGCGTGAGG | 1082. | 2.9 ± 0.2 | 1.27 ± 0.02 | N.D. | SLIT1 |
| | OT3-18 | TGTGGGTGAGTGTGTGCGTGAGG | 1083. | 13.4 ± 4.2 | 12.1 ± 0.24 | 2.42 ± 0.07 | COMDA |
| | OT3-20 | AGAGAGTGAGTGTGTGCATGAGG | 1084. | 16.7 ± 3.5 | 7.64 ± 0.05 | 1.18 ± 0.01 | |
| Target 4 (EMX1) | T4 | GAGTCCGAGCAGAAGAAGAAGGG | 1085. | 42.1 ± 0.4 | 26.0 ± 0.70 | 10.7 ± 0.50 | EMX1 |
| | OT4-1 | GAGTTAGAGCAGAAGAAGAAAGG | 1086. | 16.8 ± 0.2 | 8.43 ± 1.32 | 2.54 ± 0.02 | HCN1 |

TABLE 1-continued

On- and off-target mutations induced by RGNs
designed to endogenous human genes

| Target | Site name | Sequence | SEQ ID NO: | Indel Mutation Frequency (%) ± SEM | | | Gene |
|---|---|---|---|---|---|---|---|
| | | | | U2OS.EGFP | HEK293 | K562 | |
| Target 5 (RNF2) | T5 | GTCATCTTAGTCATTACCTGTGG | 1087. | 26.6 ± 6.0 | --- | --- | RNF2 |
| Target 6 (FANCF) | T6 | GGAATCCCTTCTGCAGCACCAGG | 1088. | 33.2 ± 6.5 | --- | --- | FANCF |

"OT" indicates off-target sites (with numbering of sites as in Table E). Mismatches from the on-target (within the 20 by region to which the gRNA hybridizes) are highlighted as bold, 5 underlined text. Mean indel mutation frequencies in U2OS.EGFP, HEK293, and K562 cells were determined as described in Methods. Genes in which sites were located (if any) are shown. All sites listed failed to show any evidence of modification in cells transfected with Cas9 expression plasmid and a control U6 promoter plasmid that did not express a functional gRNA. N.D. = none detected; --- = not tested.

Example 1d. Off-Target Mutations in Other Cell Types

Having established that RGNs can induce off-target mutations with high frequencies in U2OS.EGFP cells, we next sought to determine whether these nucleases would also have these effects in other types of human cells. We had chosen U2OS.EGFP cells for our initial experiments because we previously used these cells to evaluate the activities of TALENs[15] but human HEK293 and K562 cells have been more widely used to test the activities of targeted nucleases. Therefore, we also assessed the activities of the four RGNs targeted to VEGFA sites 1, 2, and 3 and the EMX1 site in HEK293 and K562 cells. We found that each of these four RGNs efficiently induced NHEJ-mediated indel mutations at their intended on-target site in these two additional human cell lines (as assessed by T7EI assay) (Table 1), albeit with somewhat lower mutation frequencies than those observed in U2OS.EGFP cells. Assessment of the 24 off-target sites for these four RGNs originally identified in U2OS.EGFP cells revealed that many were again mutated in HEK293 and K562 cells with frequencies similar to those at their corresponding on-target site (Table 1). As expected, DNA sequencing of a subset of these off-target sites from HEK293 cells provided additional molecular evidence that alterations are occurring at the expected genomic loci (FIGS. 9A-C). We do not know for certain why in HEK293 cells four and in K562 cells eleven of the off-target sites identified in U2OS.EGFP cells did not show detectable mutations. However, we note that many of these off-target sites also showed relatively lower mutation frequencies in U2OS.EGFP cells. Therefore, we speculate that mutation rates of these sites in HEK293 and K562 cells may be falling below the reliable detection limit of our T7EI assay (~2-5%) because RGNs generally appear to have lower activities in HEK293 and K562 cells compared with U2OS.EGFP cells in our experiments. Taken together, our results in HEK293 and K562 cells provide evidence that the high-frequency off-target mutations we observe with RGNs will be a general phenomenon seen in multiple human cell types.

Example 1e. Titration of gRNA- and Cas9-Expressing Plasmid Amounts Used for the EGFP Disruption Assay Single gRNAs were generated for three different sequences (EGFP SITES 1-3, shown above) located upstream of EGFP nucleotide 502, a position at which the introduction of frameshift mutations via non-homologous end joining can robustly disrupt expression of EGFP (Maeder, M. L. et al., Mol Cell 31, 294-301 (2008); Reyon, D. et al., Nat Biotech 30, 460-465 (2012)).

For each of the three target sites, a range of gRNA-expressing plasmid amounts (12.5 to 250 ng) was initially transfected together with 750 ng of a plasmid expressing a codon-optimized version of the Cas9 nuclease into our U2OS.EGFP reporter cells bearing a single copy, constitutively expressed EGFP-PEST reporter gene. All three RGNs efficiently disrupted EGFP expression at the highest concentration of gRNA-encoding plasmid (250 ng) (FIG. 3E (top)). However, RGNs for target sites #1 and #3 exhibited equivalent levels of disruption when lower amounts of gRNA-expressing plasmid were transfected whereas RGN activity at target site #2 dropped immediately when the amount of gRNA-expressing plasmid transfected was decreased (FIG. 3E (top)).

The amount of Cas9-encoding plasmid (range from 50 ng to 750 ng) transfected into our U2OS.EGFP reporter cells was titrated and EGFP disruption assayed. As shown in FIG. 3F (top), target site #1 tolerated a three-fold decrease in the amount of Cas9-encoding plasmid transfected without substantial loss of EGFP disruption activity. However, the activities of RGNs targeting target sites #2 and #3 decreased immediately with a three-fold reduction in the amount of Cas9 plasmid transfected (FIG. 3F (top)). Based on these results, 25 ng/250 ng, 250 ng/750 ng, and 200 ng/750 ng of gRNA-/Cas9-expressing plasmids were used for EGFP target sites #1, #2, and #3, respectively, for the experiments described in Examples 1a-1d.

The reasons why some gRNA/Cas9 combinations work better than others in disrupting EGFP expression is not understood, nor is why some of these combinations are more or less sensitive to the amount of plasmids used for transfection. Although it is possible that the range of off-target sites present in the genome for these three gRNAs might influence each of their activities, no differences were seen in the numbers of genomic sites that differ by one to six bps for each of these particular target sites (Table C) that would account for the differential behavior of the three gRNAs.

TABLE C

Numbers of off-target sites in the human genome for six RGNs targeted to endogenous human genes and three RGNs targeted to the EGFP reporter gene

| Target Site | Number of mismatches to on-target site | | | | | | |
|---|---|---|---|---|---|---|---|
| | 0 | 1 | 2 | 3 | 4 | 5 | 6 |
| Target 1 (VEGFA Site 1) | 1 | 1 | 4 | 32 | 280 | 2175 | 13873 |
| Target 2 (VEGFA Site 2) | 1 | 0 | 2 | 35 | 443 | 3889 | 17398 |
| Target 3 (VEGFA Site 3) | 1 | 1 | 17 | 377 | 6028 | 13398 | 35517 |

TABLE C-continued

Numbers of off-target sites in the human genome for six RGNs targeted to endogenous human genes and three RGNs targeted to the EGFP reporter gene

| Target Site | Number of mismatches to on-target site | | | | | | |
|---|---|---|---|---|---|---|---|
| | 0 | 1 | 2 | 3 | 4 | 5 | 6 |
| Target 4 (EMX) | 1 | 0 | 1 | 18 | 276 | 2309 | 15731 |
| Target 5 (RNF2) | 1 | 0 | 0 | 6 | 116 | 976 | 7443 |
| Target 6 (FANCF) | 1 | 0 | 1 | 18 | 271 | 1467 | 9551 |
| EGFP Target Site #1 | 0 | 0 | 3 | 10 | 156 | 1365 | 9755 |
| EGFP Target Site #2 | 0 | 0 | 0 | 11 | 96 | 974 | 7353 |
| EGFP Target Site #3 | 0 | 0 | 1 | 14 | 165 | 1439 | 10361 |

Off-target sites for each of the six RGNs targeted to the VEGFA, RNF2, FANCF, and EMX1 genes and the three RGNs targeted to EGFP Target Sites #1, #2 and #3 were identified in human genome sequence build GRCh37. Mismatches were only allowed for the 20 nt region to which the gRNA anneals and not to the PAM sequence.

Example 2: Shortening gRNA Complementarity Length to Improve RGN Cleavage Specificity It was hypothesized that off-target effects of RGNs might be minimized without compromising on-target activity simply by decreasing the length of the gRNA-DNA interface, an approach that at first might seem counterintuitive. Longer gRNAs can actually function less efficiently at the on-target site (see below and Hwang et al., 2013a; Ran et al., 2013). In contrast, as shown above in Example I, gRNAs bearing multiple mismatches at their 5' ends could still induce robust cleavage of their target sites (FIGS. 2A and 2C-2F), suggesting that these nucleotides might not be required for full on-target activity. Therefore, it was hypothesized that truncated gRNAs lacking these 5' nucleotides might show activities comparable to full-length gRNAs (FIG. 2A). It was speculated that if the 5' nucleotides of full-length gRNAs are not needed for on-target activity then their presence might also compensate for mismatches at other positions along the gRNA-target DNA interface. If this were true, it was hypothesized that gRNAs might have greater sensitivity to mismatches and thus might also induce substantially lower levels of Cas9-mediated off-target mutations (FIG. 2A).

Experimental Procedures

The following experimental procedures were used in Example 2.

Plasmid Construction

All gRNA expression plasmids were assembled by designing, synthesizing, annealing, and cloning pairs of oligonucleotides (IDT) harboring the complementarity region into plasmid pMLM3636 (available from Addgene) as described above (Example 1). The resulting gRNA expression vectors encode a ~100 nt gRNA whose expression is driven by a human U6 promoter. The sequences of all oligonucleotides used to construct gRNA expression vectors are shown in Table D. The Cas9 D10A nickase expression plasmid (pJDS271) bearing a mutation in the RuvC endonuclease domain was generated by mutating plasmid pJDS246 using a QuikChange kit (Agilent Technologies) with the following primers: Cas9 D10A sense primer 5'-tggataaaagtattctattggtttagccatcggcactaattccg-3' (SEQ ID NO:1089); Cas9 D10A antisense primer 5'-cggaattagtgccgatggctaaaccaatagaatactttttatcca-3' (SEQ ID NO:1090). All the targeted gRNA plasmids and the Cas9 nickase plasmids used in this study are available through the non-profit plasmid distribution service Addgene (addgene.org/crispr-cas).

TABLE D

Sequences of oligonucleotides used to construct gRNA expression plasmids

| | 1 | 2 | 3 | 4 | 5 | 6 | 7 | 8 | 9 | 10 | 11 | 12 | 13 | 14 | 15 | 16 | 17 | 18 | 19 | 20 | oligonucleotide 1 (5' to 3') | SEQ ID NO: | oligonucleotide 2 (5' to 3') | SEQ ID NO: |
|---|---|---|---|---|---|---|---|---|---|---|---|---|---|---|---|---|---|---|---|---|---|---|---|---|
| EGFP Target Site 1 | | | | | | | | | | | | | | | | | | | | | | | | |
| | G | G | C | C | G | T | T | C | G | A | C | G | G | G | C | A | C | G | | | ACACCGCACGGGCAGCTTGCCGGG | 1091. | AAAACGGGGCAAGCTGCCCGTGCG | 1180. |
| | G | G | C | C | G | T | T | C | G | A | C | G | G | G | C | A | C | G | | | ACACCGCACGGGCAGCTTGCCGCG | 1092. | AAAACGCGGCAAGCTGCCCGTGCG | 1181. |
| | G | c | C | C | G | T | T | C | G | A | C | G | G | G | C | A | C | G | | | ACACCGCACGGGCAGCTTGCCCGG | 1093. | AAAACCGGGCAAGCTGCCCGTGCG | 1182. |
| | G | G | C | C | G | T | T | C | G | A | C | G | G | G | C | A | C | G | | | ACACCGCACGGGCAGCTTGCCCGG | 1094. | AAAACCCGCAAGCTGCCCGTGCG | 1183. |
| | G | G | g | g | c | T | T | C | G | A | C | G | G | G | C | A | C | G | | | ACACCGCACGGGCAGCTTGCGGGG | 1095. | AAAACCCCGCAAGCTGCCCGTGCG | 1184. |
| | G | G | C | C | G | T | T | C | G | A | C | G | G | G | C | A | C | G | | | ACACCGCACGGGCAGCTTGGGCGG | 1096. | AAAACCCGGAAGCTGCCCGTGCG | 1185. |
| | G | G | C | C | c | a | a | C | g | A | C | G | G | G | C | A | C | G | | | ACACCGCACGGGCAGCTAGCCGGG | 1097. | AAAACCCGGCTAGCTGCCCGTGCG | 1186. |
| | G | G | C | C | G | T | T | C | G | A | C | G | G | G | C | A | C | G | | | ACACCGCACGGGCAGCATGCCGGG | 1098. | AAAACCCGGCATGCTGCCCGTGCG | 1187. |
| | G | G | C | C | G | T | T | C | c | A | C | G | G | G | C | A | C | G | | | ACACCGCACGGGCAACCTTGCCGGG | 1099. | AAAACCCGGCAACCTGCCCGTGCG | 1188. |
| | G | G | C | C | G | T | T | C | G | A | C | G | G | G | C | A | C | G | | | ACACCGCACGGGCACCTTGCCGGG | 1100. | AAAACCCGGCAAGGTGCCCGTGCG | 1189. |
| | G | G | C | C | G | T | T | C | G | A | C | G | G | G | C | A | C | G | | | ACACCGCACGGGCTGCTTGCCGGG | 1101. | AAAACCCGGCAAGCAGCCCGTGCG | 1190. |
| | G | G | C | C | G | T | T | C | G | t | C | G | G | G | C | A | C | G | | | ACACCGCACGGGGAGCTTGCCGGG | 1102. | AAAACCCGGCAAGCTCCCCGTGCG | 1191. |
| | G | G | C | C | G | T | T | C | G | A | C | G | G | G | C | A | C | G | | | ACACCGCACGGCCAGCTTGCCGGG | 1103. | AAAACCCGGCAAGCTGGCGTGCG | 1192. |
| | G | G | C | C | G | T | T | C | G | A | C | c | G | G | C | A | C | G | | | ACACCGCACGGCGCAGCTTGCCGGG | 1104. | AAAACCCGGCAAGCTGCGCGTGCG | 1193. |
| | G | G | C | C | G | T | T | C | G | A | C | G | c | G | C | A | C | G | | | ACACCGCACGGCAGCTTGCCGGG | 1105. | AAAACCCGGCAAGCTGCCGGTGCG | 1194. |
| | G | G | C | C | G | T | T | C | G | A | C | G | G | G | C | A | C | G | | | ACACCGCAGGGGCAGCTTGCCGGG | 1106. | AAAACCCGGCAAGCTGCCCCTGCG | 1195. |
| | G | G | C | C | G | T | T | C | G | A | C | G | G | G | g | A | t | g | | | ACACCGCTGGGCAGCTTGCCGGG | 1107. | AAAACCCGGCAAGCTGCCGAGCG | 1196. |
| | G | G | C | C | G | T | T | C | G | A | C | G | G | G | C | A | C | G | | | ACACCGGACGGGCAGCTTGCCGGG | 1108. | AAAACCCGGCAAGCTGCCCGTCCG | 1197. |
| | c | c | C | C | G | T | T | C | G | A | C | G | G | G | C | A | C | G | | | ACACCGCGGGCAGCTTGCCCCG | 1109. | AAAACCCGGGCAAGCTGCCCGTGCG | 1198. |
| | G | G | C | C | G | T | T | C | G | A | C | G | G | G | C | A | C | G | | | ACACCGCACGGGCAGCTTGGGGGG | 1110. | AAAACCCCCCAAGCTGCCCGTGCG | 1199. |
| | G | G | g | g | a | a | a | g | A | C | G | G | G | C | A | C | G | | | | ACACCGCACGGGCAGCTACCCGGG | 1111. | AAAACCCGGTAGCTGCCCGTGCG | 1200. |
| | G | G | C | C | G | T | T | C | G | A | C | G | G | G | C | A | C | G | | | ACACCGCACGGGCAGGATGCCGGG | 1112. | AAAACCCGGCATCCTGCCCGTGCG | 1201. |

TABLE D-continued

Sequences of oligonucleotides used to construct gRNA expression plasmids

| 20 | 19 | 18 | 17 | 16 | 15 | 14 | 13 | 12 | 11 | 10 | 9 | 8 | 7 | 6 | 5 | 4 | 3 | 2 | 1 | oligonucleotide 1 (5' to 3') | SEQ ID NO: | oligonucleotide 2 (5' to 3') | SEQ ID NO: |
|---|---|---|---|---|---|---|---|---|---|---|---|---|---|---|---|---|---|---|---|---|---|---|---|
| | | G | C | A | C | G | G | G | C | t | c | C | T | T | G | C | C | G | G | ACACCGCACGGGCTCCTTGCCGGG | 1113. | AAAACCCGGCAAGGAGCCCGTGCG | 1202. |
| | | G | C | A | C | G | G | G | g | A | G | C | T | T | G | C | C | G | G | ACACCGCACGGGGAGCTTGCCGGG | 1114. | AAAACCCGGCAAGCTCGCCGTGCG | 1203. |
| | | G | C | A | C | G | c | G | C | A | G | C | T | T | G | C | C | G | G | ACACCGCACCCGCAGCTTGCCGGG | 1115. | AAAACCCGGCAAGCTGCGGGTGCG | 1204. |
| | | G | C | t | C | G | G | G | C | A | G | C | T | T | G | C | C | G | G | ACACCGCTGGGGCAGCTTGCCGGG | 1116. | AAAACCCGGCAAGCTGCCCCAGCG | 1205. |
| | | G | g | t | C | G | G | G | C | A | G | C | T | T | G | C | C | G | G | ACACCGGTCGGGCAGCTTGCCGGG | 1117. | AAAACCCGGCAAGCTGCCCGACCG | 1206. |

EGFP Target Site 2

| | | | | | | | | | | | | | | | | | | | | | | | |
|---|---|---|---|---|---|---|---|---|---|---|---|---|---|---|---|---|---|---|---|---|---|---|---|
| | | G | C | C | C | G | T | T | C | T | T | C | T | T | G | T | T | G | T | ACACCGCCGTTCTTCTGCTTGTG | 1018. | AAAACACAAGCAGAAGAACGGCG | 1207. |
| | | G | C | C | C | G | T | T | C | T | T | C | T | T | G | T | T | G | T | ACACCGCCGTTCTTCTGCTTGAG | 1019. | AAAACTCAAGCAGAAGAACGGCG | 1208. |
| | | G | C | C | C | G | T | T | C | T | T | C | T | T | G | T | T | G | T | ACACCGCCGTTCTTCTGCTTCTG | 1020. | AAAACAGAAGCAGAAGAACGGCG | 1209. |
| | | G | C | C | C | G | T | T | C | T | T | C | T | T | G | T | a | G | T | ACACCGCCGTTCTTCTGCTAGTG | 1021. | AAAACACTAGCAGAAGAACGGCG | 1210. |
| | | G | C | C | C | G | T | T | C | T | T | C | T | T | G | T | T | G | T | ACACCGCCGTTCTTCTGCATGTG | 1022. | AAAACACATGCAGAAGAACGGCG | 1211. |
| | | G | C | C | C | G | T | T | C | T | T | C | T | T | G | g | T | G | T | ACACCGCCGTTCTTCTGGTTGTG | 1023. | AAAACACAACCAGAAGAACGGCG | 1212. |
| | | G | C | C | C | G | T | T | C | T | T | C | T | T | c | T | T | G | T | ACACCGCCGTTCTTCTTCAGCTTG | 1024. | AAAACACAAGGAGAAGAACGGCG | 1213. |
| | | G | C | C | C | G | T | T | C | T | T | c | T | T | G | T | T | G | T | ACACCGCCGTTCTTCTTGTGCTTGTG | 1025. | AAAACAAGCTGAAGAACGGCG | 1214. |
| | | G | C | C | C | G | T | T | C | T | a | C | T | T | G | T | T | G | T | ACACCGCCGTTCTTGTGCTTGTG | 1026. | AAAACACAAGCACAAGAACGGCG | 1215. |
| | | G | C | C | C | G | T | T | C | a | T | C | T | T | G | T | T | G | T | ACACCGCCGTTCTACTGCTTGTG | 1027. | AAAACACAAGCAGTAGAACGGCG | 1216. |
| | | G | C | C | C | G | T | T | g | T | T | C | T | T | G | T | T | G | T | ACACCGCCGTTCATCTGCTTGTG | 1028. | AAAACACAAGCAGATGAACGGCG | 1217. |
| | | G | C | C | C | G | T | a | C | T | T | C | T | T | G | T | T | G | T | ACACCGCCGTACTTCTGCTTGTG | 1029. | AAAACACAAGCAGAAGTACGGCG | 1218. |
| | | G | C | C | C | G | g | T | C | T | T | C | T | T | G | T | T | G | T | ACACCGCCGATCTTCTGCTTGTG | 1030. | AAAACACAAGCAGAAGATCGGCG | 1219. |
| | | G | C | C | C | C | T | T | C | T | T | C | T | T | G | T | T | G | T | ACACCGCCCTTCTTCTGCTTGTG | 1031. | AAAACACAAGCAGAAGAAGGGCG | 1220. |
| | | G | C | C | g | G | T | T | C | T | T | C | T | T | G | T | T | G | T | ACACCGCCGGTTCTTCTGCTTGTG | 1032. | AAAACACAAGCAGAAGAAGGCCG | 1221. |
| | | G | C | g | C | G | T | T | C | T | T | C | T | T | G | T | T | G | T | ACACCGCCGCCGTTCTTCTGCTTGTG | 1033. | AAAACACAAGCAGAAGAACGCCG | 1222. |
| | | G | c | C | C | G | T | T | C | T | T | C | T | T | G | T | T | G | T | ACACCGCCGCCGTTCTTCTGCTTGTG | 1034. | AAAACACAAGCAGAAGAACGCCG | 1223. |
| | | a | C | C | C | G | T | T | C | T | T | C | T | T | G | T | T | G | T | ACACCGCCGTTCTTCTGCTTCAG | 1035. | AAAACTGAAGCAGAAGAACGGCG | 1224. |
| | | G | C | C | C | G | T | T | C | T | T | C | T | T | G | T | T | G | a | ACACCGCCGTTCTTCTGCAAGTG | 1036. | AAAACACTTGCAGAAGAACGGCG | 1225. |
| | | G | C | C | C | G | T | T | C | T | T | C | T | T | G | T | T | G | T | ACACCGCCGTTCTTCTCGTTGTG | 1037. | AAAACACAACGAGAAGAACGGCG | 1226. |

TABLE D-continued

Sequences of oligomucleotides used to construct gRNA expression plasmids

| | 20 | 19 | 18 | 17 | 16 | 15 | 14 | 13 | 12 | 11 | 10 | 9 | 8 | 7 | 6 | 5 | 4 | 3 | 2 | 1 | oligonucleotide 1 (5' to 3') | SEQ ID NO: | oligonucleotide 2 (5' to 3') | SEQ ID NO: |
|---|---|---|---|---|---|---|---|---|---|---|---|---|---|---|---|---|---|---|---|---|---|---|---|---|
| | | | G | G | C | C | G | T | T | C | T | T | g | a | G | C | T | T | G | T | ACACCGCCGTTCTTGAGCTTGTG | 1038. | AAAACACAAGCTCAAGAACGGCG | 1227. |
| | | | G | G | C | C | G | T | T | C | a | a | C | T | G | C | T | T | G | T | ACACCGCCGTTCAACTGCTTGTG | 1039. | AAAACACAAGCAGTTGAACGGCG | 1228. |
| | | | G | G | C | C | G | T | a | G | T | T | C | T | G | C | T | T | G | T | ACACCGCCGTAGTTCTGCTTGTG | 1040. | AAAACACAAGCAGAACTACGGCG | 1229. |
| | | | G | G | C | C | G | T | T | C | T | T | C | T | G | C | T | T | G | T | ACACCGCCCATCTTCTGCTTGTG | 1041. | AAAACACAAGCAGAAGATGGGCG | 1230. |
| | | | G | G | C | C | G | g | G | T | T | C | T | T | C | T | G | C | T | T | ACACCGGGGTTCTTCTGCTTGTG | 1042. | AAAACACAAGCAGAAGAACCCCG | 1231. |

EGFP Target Site 3

| | | | G | G | T | G | G | C | A | A | T | T | G | A | A | C | T | T | C | A | ACACCGGTGCAGATGAACTTCAG | 1143. | AAAACTGAAGTTCATCTGCACCG | 1232. |
| | | | G | G | T | G | G | C | A | A | t | T | C | A | C | C | T | T | C | t | ACACCGGTGCAGATGAACTTCTG | 1144. | AAAACTCAAGTTCATCTGCACCG | 1233. |
| | | | G | G | T | G | G | C | A | A | T | T | G | A | A | g | t | a | g | A | ACACCGGTGCAGATGAACTGAG | 1145. | AAAACTGAGTTCATCTGCACCG | 1234. |
| | | | G | G | T | G | G | C | A | A | T | T | G | A | A | C | T | a | C | A | ACACCGGTGCAGATGAACTACAG | 1146. | AAAACTGTAGTTCATCTGCACCG | 1235. |
| | | | G | G | T | G | G | C | A | A | T | T | G | A | A | C | a | T | C | A | ACACCGGTGCAGATGAACATCAG | 1147. | AAAACTGATGTTCATCTGCACCG | 1236. |
| | | | G | G | T | G | G | C | A | A | T | T | G | A | A | g | T | T | C | A | ACACCGGTGCAGATGAAGTTCAG | 1148. | AAAACTGAACTTCATCTGCACCG | 1237. |
| | | | G | G | T | G | G | C | A | A | T | T | G | A | A | C | T | T | a | A | ACACCGGTGCAGATGAAGTTCAG | 1149. | AAAACTGAAGTACATCTGCACCG | 1238. |
| | | | G | G | T | G | G | C | A | A | T | T | G | A | A | C | T | g | A | A | ACACCGGTGCAGATGATCTTCAG | 1150. | AAAACTGAAGTTGATCTGCACCG | 1239. |
| | | | G | G | T | G | G | C | A | A | T | T | G | A | A | C | T | g | T | A | ACACCGGTGCAGATGTACTTCAG | 1151. | AAAACTGAAGTTCTTCTGCACCG | 1240. |
| | | | G | G | T | G | G | C | A | A | T | T | G | A | A | C | T | T | C | t | ACACCGGTGCAGATCAACTTCAG | 1152. | AAAACTGAAGTTCAACTGCACCG | 1241. |
| | | | G | G | T | G | G | C | A | A | T | T | G | A | C | A | T | T | C | A | ACACCGGTGCAGTTGAACTTCAG | 1153. | AAAACTGAAGTTCATGTGCACCG | 1242. |
| | | | G | G | T | G | G | C | A | A | T | T | G | A | A | C | A | T | C | A | ACACCGGTGCACATGAACTTCAG | 1154. | AAAACTGAAGTTCATCAGCACCG | 1243. |
| | | | G | G | T | G | G | C | A | A | T | T | G | A | g | A | T | T | C | A | ACACCGGTGCTGATGAACTTCAG | 1155. | AAAACTGAAGTTCATCTCCACCG | 1244. |
| | | | G | G | T | G | G | C | A | A | T | T | G | g | A | C | T | T | C | A | ACACCGGTGGAGATGAACTTCAG | 1156. | AAAACTGAAGTTCATCTGGACCG | 1245. |
| | | | G | G | T | G | G | C | A | A | T | T | C | A | A | C | T | T | C | A | ACACCGGTCCAGATGAACTTCAG | 1157. | AAAACTGAAGTTCATCTGCTCCG | 1246. |
| | | | G | G | T | G | G | C | A | A | T | T | g | A | A | C | T | T | C | A | ACACCGGAGCAGATGAACTTCAG | 1158. | AAAACTGAAGTTCATCTGCAGCG | 1247. |
| | | | G | G | T | G | G | C | A | A | T | a | G | A | A | C | T | T | C | A | ACACCGGTGCAGATGAACTTGTG | 1159. | AAAACTGAAGTTCTACTGCACCG | 1248. |
| | | | G | G | T | G | G | C | A | t | T | T | G | A | A | C | T | T | C | A | ACACCGGTGCAGATGAACTGTG | 1160. | AAAACACAAGTTCATCTGCACCG | 1249. |
| | | | G | G | T | G | G | C | a | A | T | T | G | A | A | C | T | T | C | A | ACACCGGTGCAGATGAACACAG | 1161. | AAAACTGTTGTTGAACATCATCTGCACCG | 1250. |
| | | | G | G | T | G | G | C | t | A | T | T | G | A | A | C | T | T | C | A | ACACCGGTGCAGATGATGTCAG | 1162. | AAAACTGAACATCATCTGCACCG | 1251. |
| | | | G | G | T | G | G | t | A | A | T | T | G | A | A | C | T | T | C | A | ACACCGGTGCAGATCTACTTCAG | 1163. | AAAACTGAAGTAGATCTGCACCG | 1252. |
| | | | G | G | T | G | G | t | A | A | T | T | G | A | A | C | T | T | C | A | ACACCGGTGCAGATCTACTTCAG | 1164. | AAAACTGAAGTTCTACTGCACCG | 1253. |
| | | | G | G | T | G | t | T | A | A | T | T | G | A | t | C | T | C | A | A | ACACCGGTGCTCATGAACTTCAG | 1165. | AAAACTGAAGTTCATGAGCACCG | 1254. |
| | | | G | G | T | G | a | T | A | A | T | T | G | A | A | C | T | C | A | A | ACACCGGTCGAGATGAACTTCAG | 1166. | AAAACTGAAGTTCATCTCGACCG | 1255. |
| | | | G | G | c | a | g | c | A | A | T | a | t | T | t | C | T | C | C | A | ACACCGAGCAGATGAACTTCAG | 1167. | AAAACTGAAGTTCATCTGCTCTG | 1256. |

Endogenous Target 1 (VEGFA Site 1 tru-gRNA):

| G | T | G | G | G | G | G | G | A | G | T | T | T | G | C | T | C | C | | | | ACACCGTGGGGGGAGTTTGCTCCG | | AAAACGGAGCAAACTCCCCCACG | 1168. 1257. |

Endogenous Target 3 (VEGFA Site 3 tru-gRNA):

| G | A | G | T | G | A | G | T | G | T | G | T | G | T | G | T | G | G | | | | ACACCGAGTGAGTGTGTGCGTGG | | AAAACCACGCACACACTCACTCG | 1169. 1258. |

TABLE D-continued

Sequences of oligomucleotides used to construct gRNA expression plasmids

| Label | oligonucleotide 1 (5' to 3') | SEQ ID NO: | oligonucleotide 2 (5' to 3') | SEQ ID NO: |
|---|---|---|---|---|
| Endogenous Target 4 (EMX1 site 1 tru-gRNA) | ACACCGTCCGAGCAGAAGAAGAAG | 1170 | AAAACTTCTTCTTCTGCTCGGACG | 1259 |
| CTLA full-length gRNA | ACACCGCAGATGTAGTGTTTCCACAG | 1171 | AAAACTGTGGAAACACTACATCTGCG | 1260 |
| CTLA tru-gRNA | ACACCGATGTAGTGTTTCCACAG | 1172 | AAACTGTGGAAACACTACATCG | 1261 |
| VEGFA site 4 full-length gRNA | ACACCTCCCTCTTTAGCCAGAGCCGG | 1173 | AAAACCGGCTCTGCTAAAGAGGGAG | 1262 |
| EMX1 site 2 full-length gRNA | ACACCGCCGTTTGTACTTTGTCCTCG | 1174 | AAAACGAGGACAAAGTACAAACGGCG | 1263 |
| EMX1 site 2 tru-gRNA | ACACCGTTGTACTTTGTCCTCG | 1175 | AAAACGAGGACAAAGTACAAACG | 1264 |
| EMX1 site 3 full-length gRNA | ACACCGGGAAGACTGAGGCTACATAG | 1176 | AAAACTATGTAGCCTCAGTCTTCCCG | 1265 |
| EMX1 site 3 tru-gRNA | ACACCGAAGACTGAGGCTACATAG | 1177 | AAAACTATGTAGCCTCAGTCTTCG | 1266 |
| EMX1 site 4 full-length gRNA | ACACCGAGGCCCCAGAGCAGCCACG | 1178 | AAAACGTGGCTGCTCTGGGGCCTCG | 1267 |
| EMX1 site 4 tru-gRNA | ACACCGCCCCAGAGCAGCCACG | 1179 | AAAACGTGGCTGCTCTGGGGGCG | 1268 |

Human Cell-Based EGFP Disruption Assay

U2OS.EGFP cells harboring a single-copy, integrated EGFP-PEST gene reporter have been previously described (Reyon et al., 2012). These cells were maintained in Advanced DMEM (Life Technologies) supplemented with 10% FBS, 2 mM GlutaMax (Life Technologies), penicillin/streptomycin and 400 µg/ml G418. To assay for disruption of EGFP expression, $2\times10^5$ U2OS.EGFP cells were transfected in duplicate with gRNA expression plasmid or an empty U6 promoter plasmid as a negative control, Cas9 expression plasmid (pJDS246) (Example 1 and Fu et al., 2013), and 10 ng of td-Tomato expression plasmid (to control for transfection efficiency) using a LONZA 4D-Nucleofector™, with SE solution and DN100 program according to the manufacturer's instructions. We used 25 ng/250 ng, 250 ng/750 ng, 200 ng/750 ng, and 250 ng/750 ng of gRNA expression plasmid/Cas9 expression plasmid for experiments with EGFP site #1, #2, #3, and #4, respectively. Two days following transfection, cells were trypsinized and resuspended in Dulbecco's modified Eagle medium (DMEM, Invitrogen) supplemented with 10% (vol/vol) fetal bovine serum (FBS) and analyzed on a BD LSRII flow cytometer. For each sample, transfections and flow cytometry measurements were performed in duplicate.

Transfection of Human Cells and Isolation of Genomic DNA

To assess the on-target and off-target indel mutations induced by RGNs targeted to endogenous human genes, plasmids were transfected into U2OS.EGFP or HEK293 cells using the following conditions: U2OS.EGFP cells were transfected using the same conditions as for the EGFP disruption assay described above. HEK293 cells were transfected by seeding them at a density of $1.65\times10^5$ cells per well in 24 well plates in Advanced DMEM (Life Technologies) supplemented with 10% FBS and 2 mM GlutaMax (Life Technologies) at 37° C. in a $CO_2$ incubator. After 22-24 hours of incubation, cells were transfected with 125 ng of gRNA expression plasmid or an empty U6 promoter plasmid (as a negative control), 375 ng of Cas9 expression plasmid (pJDS246) (Example 1 and Fu et al., 2013), and 10 ng of a td-Tomato expression plasmid, using Lipofectamine LTX reagent according to the manufacturer's instructions (Life Technologies). Medium was changed 16 hours after transfection. For both types of cells, genomic DNA was harvested two days post-transfection using an Agencourt DNAdvance genomic DNA isolation kit (Beckman) according to the manufacturer's instructions. For each RGN sample to be assayed, 12 individual 4D transfection replicates were performed, genomic DNA was isolated from each of these 12 transfections, and then these samples were combined to create two "duplicate" pools each consisting of six pooled genomic DNA samples. Indel mutations were then assessed at on-target and off-target sites from these duplicate samples by T7EI assay, Sanger sequencing, and/or deep sequencing as described below.

To assess frequencies of precise alterations introduced by HDR with ssODN donor templates, $2\times10^5$ U2OS.EGFP cells were transfected 250 ng of gRNA expression plasmid or an empty U6 promoter plasmid (as a negative control), 750 ng Cas9 expression plasmid (pJDS246), 50 pmol of ssODN donor (or no ssODN for controls), and 10 ng of td-Tomato expression plasmid (as the transfection control). Genomic DNA was purified three days after transfection using Agencourt DNAdvance and assayed for the introduction of a BamHI site at the locus of interest as described below. All of these transfections were performed in duplicate.

For experiments involving Cas9 nickases, $2\times10^5$ U2OS.EGFP cells were transfected with 125 ng of each gRNA expression plasmid (if using paired gRNAs) or 250 ng of gRNA expression plasmid (if using a single gRNA), 750 ng of Cas9-D10A nickase expression plasmid (pJDS271), 10 ng of td-Tomato plasmid, and (if performing HDR) 50 pmol of ssODN donor template (encoding the BamHI site). All transfections were performed in duplicate. Genomic DNA harvested two days after transfection (if assaying for indel mutations) or three days after transfection (if assaying for HDR/ssODN-mediated alterations) using the Agencourt DNAdvance genomic DNA isolation kit (Beckman).

T7EI Assays for Quantifying Frequencies of Indel Mutations

T7EI assays were performed as previously described (Example 1 and Fu et al., 2013). In brief, PCR reactions to amplify specific on-target or off-target sites were performed with Phusion high-fidelity DNA polymerase (New England Biolabs) using one of the two following programs: (1) Touchdown PCR program [(98° C., 10 s; 72-62° C., −1° C./cycle, 15 s; 72° C., 30 s)×10 cycles, (98° C., 10 s; 62° C., 15 s; 72° C., 30 s)×25 cycles] or (2) Constant Tm PCR program [(98° C., 10 s; 68° C. or 72° C., 15 s; 72° C., 30 s)×35 cycles], with 3% DMSO or 1 M betaine if necessary. All primers used for these amplifications are listed in Table E. Resulting PCR products ranged in size from 300 to 800 bps and were purified by Ampure XP beads (Agencourt) according to the manufacturer's instructions. 200 ng of purified PCR products were hybridized in 1×NEB buffer 2 in a total volume of 19 µl and denatured to form heteroduplexes using the following conditions: 95° C., 5 minutes; 95 to 85° C., −2° C./s; 85 to 25° C., −0.1° C./s; hold at 4° C. 1 µl of T7 Endonuclease I (New England Biolabs, 10 units/µl) was added to the hybridized PCR products and incubated at 37° C. for 15 minutes. The T7EI reaction was stopped by adding 2 µl of 0.25 M EDTA solution and the reaction products were purified using AMPure XP beads (Agencourt) with elution in 20 µl 0.1×EB buffer (QIAgen). Reactions products were then analyzed on a QIAXCEL capillary electrophoresis system and the frequencies of indel mutations were calculated using the same formula as previously described (Reyon et al., 2012).

TABLE E

| Publication ID | Expected Off-Target Sequences (Expected) - HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| Target 1 | GGGTGGGGGAG TTTGCTCCTGG | 1269. | 0 | | TCCAGATGCACA TTGTCAG | 1270. | AGGGAGCA GGAAAGTG AGGT | 1271. | DMSO | | | |
| OT1-1 | GGGTGGGGGAG TTTGCCCCAGG | 1272. | 1 | | GGGGCCCACTCTT CTTCCAT | 1273. | ACCCAGAC TCCTGGTG TGGC | 1279. | No DMSO | 0 | 0 | 1 |
| OT1-2 | GCGTGGGGGTG TTTGCTCCTGG | 1275. | 2 | | GCTAAGCAGAGAT GCCTATGCC | 1276. | ACCACCCT TTCCCCCA GAAA | 1277. | DMSO | 2 | 0 | 0 |
| OT1-3 | GGATGAGGGAG TTTGCTCCTGG | 1278. | 2 | | ACCCCACAGCCAG GTTTTCA | 1279. | GAATCACT GCACCTGG CCATC | 1280. | DMSO | 0 | 0 | 2 |
| OT1-4 | GGGAGGGTGGAG TTTGCTCCTGG | 1281. | 2 | | TGCCGCAACTTCA GACAACC | 1282. | TAAAGGGC GTGCTGGG AGAG | 1283. | DMSO | 1 | 1 | 0 |
| OT1-5 | GGGTGGGTGGAG TTTGCTACTGG | 1284. | 2 | | GCATGTCAGGATC TGACCCC | 1285. | TGCAGGGC CATCTTGT GTGT | 1286. | DMSO | 0 | 2 | 0 |
| OT1-6 | CGGGGGAGGGAG TTTGCTCCTGG | 1287. | 3 | | CCACCACATGTTC TGGGTGC | 1288. | CTGGGTCT GTTCCCTG TGGG | 1289. | DMSO | 1 | 1 | 1 |
| OT1-7 | GACTGGGTGGAG TTTGCTACAGG | 1290. | 3 | | GGCTCTCCCTGCC CTAGTTT | 1291. | GCAGGTCA AGTTGAAA CCCG | 1292. | DMSO | 0 | 2 | 1 |
| OT1-8 | GGGAGGGAGAG TTTGTTCCAGG | 1293. | 3 | | GGGGCTGAGAACA CATGAGATGCA | 1294. | AGATTTGT GCACTGCC TGCCT | 1295. | DMSO | 1 | 0 | 2 |
| OT1-9 | GGGAGGGGCAG GTTGCTCCAGG | 1296. | 3 | | CCCGACCTTCCGCT CCAAAGC | 1297. | GGACCTCT GCACACCC TGGC | 1298. | DMSO | 2 | 1 | 0 |
| OT1-10 | GGGAGGGGGAG TGTGTTCCGGG | 1299. | 3 | | TGCAAGGTCGCAT AGTCCCA | 1300. | CAGGAGGG GGAAGTGT GTCC | 1301. | DMSO | 1 | 1 | 1 |

TABLE E-continued

| Publication ID | Expected Off-Target Sequences (Expected) - HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT1-11 | GGGGAGGGGAAG TTTGCTCCAGG | 1302. | 3 | | GCCCATTCTTTT GCAGTGGA | 1303. | GAGAGCAA GTTTGTTC CCCAGG | 1304. | DMSO | 0 | 1 | 2 |
| OT1-12 | GGGGGTGGGGAC TTTGCTCCAGG | 1305. | 3 | | GCCCCCAGCCCCT CTGTTTC | 1306. | GCTGCTGG TAGGGGAG CTGG | 1307. | DMSO | 1 | 2 | 0 |
| OT1-13 | GGGTCGGGGGAG TGGGCTCCAGG | 1308. | 3 | | CGGCTGCCTTCCC TGAGTCC | 1309. | GGGTGACG CTTGCCAT GAGC | 1310. | 72C Anneal, 3% DMSO | 1 | 2 | 0 |
| OT1-14 | GGGTGCTGGAG TTTGCTGCTGG | 1311. | 3 | | TGACCCTGGAGTA CAAAATGTTCCCA | 1312. | GCTGAGAC AACCAGCC CAGCT | 1313. | 72C Anneal, 3% DMSO | 2 | 1 | 0 |
| OT1-15 | GGGTGGGGGGTG CCTGCTCCAGG | 1314. | 3 | | TGCCTCCACCCTT AGCCCCT | 1315. | GCAGCCGA TCCACACT GGGG | 1316. | DMSO | 1 | 0 | 2 |
| OT1-16 | GGTTGAGGGGAG TCTGCTCCAGG | 1317. | 3 | | AACTCAGGACAAC ACTGCCTGT | 1318. | CCCAGGAG CAGGGTAC AATGC | 1319. | DMSO | 0 | 1 | 2 |
| OT1-17 | GTGTGGGTGGCG TTTGCTCCAGG | 1320. | 3 | | TCCTCCTTGGAGA GGGGCCC | 1321. | CCTTGGAA GGGGCCTT GGTGG | 1322. | DMSO | 0 | 3 | 0 |
| OT1-18 | AGGTGGTGGGAG CTTGTTCCTGG | 1323. | 4 | | CCGAGGGGCATGGG CAATCCT | 1324. | GGCTGCTG CGAGTTGC CAAC | 1325. | DMSO | 0 | 1 | 3 |
| OT1-19 | AGTTTGGGGGAG TTTGCCCCAGG | 1326. | 4 | | TGCTTTGCATGGG GTCTCAGACA | 1327. | GGGTTGCT TGCCCTCT GTGT | 1328. | DMSO | 0 | 2 | 2 |
| OT1-20 | ATGTGTGGGAA TTTGCTCCAGG | 1329. | 4 | | AGCTCCTTCTCAT TTCTCTTCTGCTG T | 1330. | CACAGAAG GATGTGTG CAGGTT | 1331. | DMSO | 0 | 2 | 2 |
| OT1-21 | CAGTGGGGGAG CTTTCTCCTGG | 1332. | 4 | | AGCAGACACAGGT GAATGCTGCT | 1333. | GGTCAGGT GTGCTGCT AGGCA | 1339. | DMSO | 1 | 1 | 2 |

TABLE E-continued

| Publication ID | Expected Off-Target Sequences - HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT1-22 | GAGGGGAGCAG TTTGCTCCAGG | 1335. | 4 | | CCTGTGGGCTCT CAGGTGC | 1336. | ACTGCCTG CCAAAGTG GGTGT | 1337. | No DMSO TD | 1 | 1 | 2 |
| OT1-23 | GGAGGAGGGGAG TCTGCTCCAGG | 1338. | 4 | | AGCTGCACTGGGG AATGAGT | 1339. | TGCCGGGT AATAGCTG GCTT | 1340. | DMSO | 0 | 1 | 3 |
| OT1-24 | GGAGGGGGGGCT TTTGCTCCAGG | 1341. | 4 | | CCAGCCTGGGCAA CAAAGCG | 1342. | GGGGGCTT CCAGGTCA CAGG | 1343. | 72C Anneal, 3% DMSO, 6% DMSO | 0 | 3 | 1 |
| OT1-25 | GGGCAAGGGGAG GTTGCTCCTGG | 1344. | 4 | | TACCCCCACTGCC CCATTGC | 1345. | ACAGGTCC ATGCTTAG CAGAGGG | 1346. | DMSO | 0 | 1 | 3 |
| OT1-26 | GGGTGATTGAAG TTTGCTCCAGG | 1347. | 4 | GGGTGATTGAAGTT TGCTCCAGG (SEQ ID NO: 2225) GGGTGATTGAAGTT TGCTGCAGG (SEQ ID NO: 2226) | ACGGATTCACGAC GGAGTGC | 1348. | CCGAGTCC GTGGCAGA GAGC | 1349. | DMSO | 0 / 1 | 2 | 2 |
| OT1-27 | GGGTGTGGGGTC ATTGCTCCAGG | 1350. | 4 | | TGTGTTGAAGTA GGGGACAGGT | 1351. | TGGCCCAA TTGGAAGT GATTTCGT | 1352. | DMSO | 3 | 1 | 0 |
| OT1-28 | GGTGGGGGTGGG TTTGCTCCAGG | 1353. | 4 | | TGGGATGGCAGAG TCATCAACGT | 1354. | GGCCCAAT CGGTAGAG GATGCA | 1355. | DMSO | 0 | 3 | 1 |
| OT1-29 | GTGGGGGTAGAG TTTGCTCCAGG | 1356. | 4 | | ATGGGGCGCTCCA GTCTGTG | 1357. | TGCACCCA CACAGCCA GCAA | 1358. | DMSO | 0 | 3 | 1 |
| OT1-30 | TAGTGAGGGAG CTTGCTCCTGG | 1359. | 4 | | GGGGAGGGAGGAC CAGGGAA | 1360. | AATTAGCT GGGCGCGG TGGT | 1361. | 72C Anneal, 3% DMSO | 0 | 1 | 3 |

TABLE E-continued

| Publication ID | Expected Off-Target Sequences HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT1-31 | TGCTCGGGGAGTTTGCACCAGG | 1362. | 4 | | ATCCCGTGCAGGAAGTCGCC | 1363. | CAGGCCGCCCCTTGAGGAAT | 1364. | DMSO | 3 | 1 | 0 |
| OT1-32 | TGGAGAGGGGAGTTGGCTCCTGG | 1365. | 4 | | CCCCAACCCTTTGCTCAGCG | 1366. | TGAGGAGAACACCACAGGCAGA | 1367. | DMSO | 1 | 2 | 1 |
| OT1-33 | TGGTGTTTGGGAGTCTGCTCCAGG | 1368. | 4 | | ATCGACGAGGAGGGGGCCTT | 1369. | CCCCTCACTCAAGCAGGCCC | 1370. | DMSO | 0 | 3 | 1 |
| OT1-34 | TTTGGGGGGCAGTTTGCTCCTGG | 1371. | 4 | | TGCTCAAGGGGCCTGTTCCA | 1372. | CAGGGCAGTGGCAGGAGTC | 1373. | No DMSO | 1 | 3 | 0 |
| OT1-35 | AAGTAAGGGAAGTTTGCTCCTGG | 1374. | 5 | | TGCCTGGCACGCAGTAGGTG | 1375. | GGGAAGGGGAACAGGTGCA | 1376. | DMSO | 0 | 0 | 5 |
| OT1-36 | AGAAGAGGGGATTTTGCTCCTGG | 1377. | 5 | | Not optimized | | | | | 1 | 1 | 3 |
| OT1-37 | ATCTGGGTGATTTTGCTCCTGG | 1378. | 5 | | ACCTGGGCTTGCCACTAGGG | 1379. | GCTGCTCGCAGTTAAGCACCA | 1380. | DMSO | 1 | 3 | 1 |
| OT1-38 | CTCTGCTGGGAGTTTGCTCCTGG | 1381. | 5 | | GTGGCCGGGCTACTGCTACC | 1382. | GGTTCCACAAGCTGGGGGCA | 1383. | DMSO | 3 | 2 | 0 |
| OT1-39 | CTGGTGGGGGAGCTTGCTCCAGG | 1384. | 5 | | Not optimized | | | | | 1 | 3 | 1 |
| OT1-40 | CTTTCGGGGGAGTTTGCGCCGGG | 1385. | 5 | | GCAAGAGGCGGAGGAGACCC | 1386. | AGAGTCATCCATTTCCTGGGGGC | 1387. | DMSO | 2 | 3 | 0 |
| OT1-41 | CTTTGGGGTTAGTTTGCTCCTGG | 1388. | 5 | | GGGGTCAGTGGTGATATCCCCCT | 1389. | AGGGAATCCTTTTTCCATTGCTTGTTT | 1390. | 1M betaine, TD | 1 | 4 | 0 |

TABLE E-continued

| Publication ID | Expected Off-Target Sequences (Expected) - HS GRCh37 | Mismatches in target compared to on-target site | Actual Target in U2OS.EGFP cells | SEQ ID NO: | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT1-42 | GCTCTCGGGTAG TTTGCTCCAGG | 5 | | 1391. | AGAGAGGCCACGT GGAGGGT | 1392. | GCCTCCCC TCCTCCTT CCCA | 1393. | DMSO | 1 | 3 | 1 |
| OT1-43 | GTCTCTCGGGAG TTTGCTCCTGG | 5 | | 1394. | GACAGTGCCTTGC GATGCAC | 1395. | TCTGACCG GTATGCCT GACG | 1396. | DMSO | 3 | 2 | 0 |
| OT1-44 | TCCTGAGGGCAG TTTGCTCCAGG | 5 | | 1397. | TGTGTGAACCCAG CCTGGCT | 1398. | TGGTCTAG TACTTCCT CCAGCCTT | 1399. | DMSO | 3 | 1 | 1 |
| OT1-45 | TCTTTGGGAGAG TTTGCTCCAGG | 5 | | 1400. | GGTTCTCCCTTGG CTCCTGTGA | 1401. | CCCACTGC TCCTAGCC CTGC | 1402. | DMSO | 1 | 3 | 1 |
| OT1-46 | ACAACTGGGGAG TTTGCTCCTGG | 6 | | 1403. | TGAAGTCAACAAT CTAAGCTTCCACC T | 1404. | AGCTTTGG TAGTTGGA GTCTTTGA AGG | 1405. | DMSO | 3 | 1 | 2 |
| OT1-47 | ACAAGGTGGAAG TTTGCTCCTGG | 6 | | 1406. | TGATTGGGCTGCA GTTCATGTACA | 1407. | GCACAGCC TGCCCTTG GAAG | 1408. | DMSO | 2 | 1 | 3 |
| OT1-48 | ACATAGAAGGAG TTTGCTCCAGG | 6 | | 1409. | TCCATGGGCCCCT CTGAAAGA | 1410. | AGCGGCTT CTGCTTCT GCGA | 1411. | DMSO | 1 | 0 | 5 |
| OT1-49 | AGACCCAGGGAG TTTGCTCCCGG | 6 | | 1412. | GCGGTTGGTGGGG TTGATGC | 1413. | GAGTTCCT CCTCCCGC CAGT | 1414. | DMSO | 2 | 0 | 4 |
| OT1-50 | AGACCCAGGGAG TTTGCTCCCGG | 6 | | 1415. | AGGCAAGATTTTC CAGTGTGCAAGA | 1416. | GCTTTTGC CTGGGACT CCGC | 1417. | DMSO No | 2 | 0 | 4 |
| OT1-51 | CACGGAGGGGTG TTTGCTCCTGG | 6 | | 1418. | GCTGCTGGTCGGG CTCTCTG | 1419. | GCTCTGTC CCACTTCC CCTGG | 1420. | DMSO TD | 3 | 1 | 2 |
| OT1-52 | CAGAGCTTGGAG TTTGCTCCAGG | 6 | | 1421. | GCTGCGAGGCTTC CGTGAGA | 1422. | CGCCCCTA GAGCTAAG GGGGT | 1423. | DMSO | 3 | 2 | 1 |

TABLE E-continued

| Publication ID | Expected Off-Target Sequences - HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT1-53 | CTATTGATGGAG TTTGCTCCTGG | 1424. | 6 | | CCAGGAGCCTGAG AGCTGCC | 1425. | AGGGCTAG GACTGCAG TGAGC | 1426. | DMSO | 1 | 3 | 2 |
| OT1-54 | CTTTCTAGGGAG TTTGCTCCTGG | 1427. | 6 | | CTGTGCTCAGCCT GGGTGCT | 1428. | GCCTGGGG CTGTGAGT AGTTT | 1429. | DMSO | 2 | 3 | 1 |
| OT1-55 | GCCATGCTGGAG TTTGCTCCAGG | 1430. | 6 | | AGCTCGCGCCAGA TCTGTGG | 1431. | ACTTGGCA GGCTGAGG CAGG | 1432. | 72C Anneal, 3% DMSO | 4 | 2 | 0 |
| Target 2 | | 1433. | | | | 1434. | | 1435. | | | | |
| OT2-1 | GACCCCCTCCAC CCCGCCTCCGG | 1436. | 0 | | AGAGAAGTCGAGG AAGAGAGAG | 1437. | CAGCAGAA AGTTCATG GTTTCG | 1438. | DMSO | | | |
| OT2-2 | GACCCCCCCCAC CCCGCCTCCGG | 1439. | 2 | | TGGACAGCTGCAG TACTCCTG | 1440. | ACTGATCG ATGATGCC CTATGGGT | 1441. | DMSO | 0 | 0 | 2 |
| OT2-3 | GGGCCCCTCCAC CCCGCCTCTGG | 1442. | 2 | | CAAGATGTGCACT TGGGCTA | 1443. | GCAGCCTA TTGTCTCC TGGT | 1444. | DMSO | 1 | 0 | 1 |
| OT2-4 | AACCCCATCCAC CCGGCCTCAGG | 1445. | 3 | | GTCCAGTGCCTGA CCCTGGC | 1446. | AGCATCAT GCCTCCAG CTTCA | 1447. | DMSO | 1 | 1 | 1 |
| OT2-5 | CACCCCCTCAAC ACCGCCTCAGG | 1448. | 3 | | GCTCCCGATCCTC TGCCACC | 1449. | GCAGCTCC CACCACCC TCAG | 1450. | DMSO | 1 | 2 | 0 |
| OT2-6 | CACCCCCTCCCC TCCGCCTCAGG | 1451. | 3 | | GGGGACAGGCAGG CAAGGAG | 1452. | GTGCGTGT CCGTTCAC CCCT | 1453. | DMSO | 1 | 1 | 1 |
| | CTACCCCTCCAC CCCGCCTCCGG | 1454. | 3 | | AAGGGGCTGCTGG GTAGGAC | 1455. | CGTGATTC GAGTTCCT GGCA | 1456. | DMSO | 2 | 1 | 0 |

TABLE E-continued

| Publication ID | Expected Off-Target Sequences (Expected) - HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT2-7 | GACCCGCCCCGC CCCGCCTCTGG | 1457. | 3 | | GACCCCTCAGGAAG CTGGGAG | 1458. | CTGCGAGA TGCCCCAA ATCG | 1459. | 1M betaine, TD | 1 | 0 | 2 |
| OT2-8 | GATCGACTCCAC CCCGCCTCTGG | 1460. | 3 | | CCGCGGCGCTCTG CTAGA | 1461. | TGCTGGGA TTACAGGC GCGA | 1462. | DMSO | 1 | 1 | 1 |
| OT2-9 | GCCCCCACCCAC CCCGCCTCTGG | 1463. | 3 | | CCAGTGGTGTCA GCGAGG | 1464. | TGCCTCGC CCTCTCTG AGTCT | 1465. | DMSO | 0 | 2 | 1 |
| OT2-10 | GCCCCGCTCCTC CCCGCCTCGG | 1466. | 3 | | CGACTCCACCGCG TCTCAGG | 1467. | CAGCGCAG TCCAGCCC GATG | 1468. | 1M betaine, TD | 2 | 1 | 0 |
| OT2-11 | GGCCCCTCCAC CAGGCCTCAGG | 1469. | 3 | | CTTCCCTCCCCCA GCACCAC | 1470. | GCTACAGG TTGCACAG TGAGAGGT | 1471. | DMSO | 1 | 1 | 1 |
| OT2-12 | GGCCCCCTCCTC CTCGCCTCTGG | 1472. | 3 | | CCCCGGGGAGTCT GTCCTGA | 1473. | CCCAGCCG TTCCAGGT CTTCC | 1477. | DMSO | 1 | 0 | 2 |
| OT2-13 | GGCGCCCTCCAC CCTGCCTCGGG | 1475. | 3 | | GAAGCGCGAAAAC CCGGCTC | 1476. | TCCAGGGT CCTTCTCG GCCC | 1477. | DMSO | 1 | 0 | 2 |
| OT2-14 | GTCCTCCACCAC CCCGCCTCTGG | 1478. | 3 | | AGGGTGGTCAGGG AGGCCTT | 1479. | CATGGGGC TCGGACCT CGTC | 1480. | DMSO | 2 | 0 | 1 |
| OT2-15 | TACCCCCACAC CCCGCCTCTGG | 1481. | 3 | | GGGAAGAGGCCAGG GCTGTCG | 1482. | TGCCAGGA AGGAAGCT GGCC | 1483. | 72C Anneal, 3% DMSO | 0 | 2 | 1 |
| OT2-16 | AACCCATTCCAC CCTGCCTCAGG | 1484. | 4 | | GAGTGACGATGAG CCCCGGG | 1485. | CCCTTAGC TGCAGTCG CCCC | 1486. | 68C Anneal, 3% DMSO | 0 | 1 | 3 |

TABLE E-continued

| Publication ID | Expected Off-Target Sequences (Expected) - HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT2-17 | ACACCCCCCAC CCCGCCTCAGG | 1487. | 4 | | CCCATGAGGGGTT TGAGTGC | 1488. | TGAAGATG GGCAGTTT GGGG | 1489. | DMSO | 0 | 2 | 2 |
| OT2-18 | AGCCCCCACCTC CCCGCCTCTGG | 1490. | 4 | | CACCTGGGCATC TGGGTGG | 1491. | ACTGGGGT TGGGAGG GGAT | 1492. | DMSO | 2 | 0 | 2 |
| OT2-19 | ATTCCCCCCAC CCCGCCTCAGG | 1493. | 4 | | TCATGATCCCCAA AAGGGCT | 1494. | CCATTTGT GCTGATCT GTGGGT | 1495. | DMSO | 1 | 0 | 3 |
| OT2-20 | CCCACCCCCAC CCCGCCTCAGG | 1496. | 4 | | TGGTGCCCAGAAT AGTGGCCA | 1497. | AGGAAATG TGTTGTGC CAGGGC | 1498. | DMSO | 1 | 2 | 1 |
| OT2-21 | CCCCCCACCAC CCCGCCCGGG | 1499. | 4 | | GCCTCAGACAACC CTGCCCC | 1500. | GCCAAGTG TTACTCAT CAAGAAAG TGG | 1501. | No DMSO TD | 2 | 1 | 1 |
| OT2-22 | CCCCCCCCCCC CCCGCCTCTGG | 1502. | 4 | | GCCGGACAAGAC TGAGTTGGG | 1503. | TCCCGAAC TCCCGCAA AACG | 1504. | DMSO | 1 | 2 | 1 |
| OT2-23 | CGCCCTCCCCAC CCCGCCTCCGG | 1505. | 4 | | TGCTGCAGGTGGT TCCCGAG | 1506. | CTGGAACC GCATCCTC CGCA | 1507. | No DMSO TD | 1 | 0 | 3 |
| OT2-24 | CTCCCCACCCAC CCCGCCTCAGG | 1508. | 4 | | ACACTGGTCCAGG TCCCGTCT | 1509. | GGCTGTGC CTTCCGAT GGAA | 1510. | DMSO | 2 | 1 | 1 |
| OT2-25 | CTCTCCCCCAC CCCGCCTCTGG | 1511. | 4 | CTCTCCCCCACCC CCCCTCTGG (SEQ ID NO: 2227) | ATCGCGCCCAAAG CACAGGT | 1512. | AGGCTTCT GGAAAAGT CCTCAATG CA | 1513. | DMSO | 3 | 0 | 2 |
| OT2-26 | GCCTCTCTGCAC CCCGCCTCAGG | 1514. | 4 | | Not optimized | | | | | 1 | 1 | 2 |
| OT2-27 | GTCACTCCCCAC CCCGCCTCTGG | 1515. | 4 | | CCCTCATGGTGGT CTTACGGCA | 1516. | AGCCACAC ATCTTTCT GGTAGGG | 1517. | DMSO | 1 | 1 | 2 |

TABLE E-continued

| Publication ID | Expected Off-Target Sequences - HS GRCh37 | Mismatches in target compared to on-target site | Actual Target in U2OS.EGFP cells | SEQ ID NO: | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT2-28 | TGCCCCCTCCCC CCAGCCTCTGG | 4 | | 1518. | TGCGTCGCTCATG CTGGGAG | 1519. | AGGGTGGG GTGTACTG GCTCA | 1520. | DMSO | 0 | 3 | 1 |
| OT2-29 | TGCCCCTCCAC CCCGCCTCTGG | 4 | | 1521. | GAGCTGAGACGGC ACCACTG | 1522. | TGGCCTTG AACTCTTG GGCT | 1523. | 1M betaine, TD | 0 | 1 | 3 |
| OT2-30 | TTCCCCTTCCAC CCAGCCTCTGG | 4 | | 1524. | Not optimized | | | | | 1 | 2 | 1 |
| OT2-31 | TTCTCCCTCTC CCCGCCTCGGG | 4 | | 1525. | AGTGAGAGTGGCA CGAACCA | 1526. | CAGTAGGT GGTCCCTT CCGC | 1527. | DMSO | 2 | 1 | 1 |
| OT2-32 | ACCCTGCCCAC CCCGCCTCAGG | 5 | | 1528. | Not optimized | | | | | 1 | 1 | 3 |
| OT2-33 | AGCCAACCCAC CCCGCCTCTGG | 5 | | 1529. | GGGAGAACCTTGT CCAGCCT | 1530. | AAGCCGAA AAGCTGGG CAAA | 1531. | DMSO | 0 | 2 | 3 |
| OT2-34 | AGGCCCCCACAC CCCGCCTCAGG | 5 | | 1532. | CTTCCCAGTGTGG CCCGTCC | 1533. | ACACAGTC AGAGCTCC GCCG | 1534. | DMSO | 1 | 1 | 3 |
| OT2-35 | AGGCCCCCCGC CCCGCCTCAGG | 5 | | 1535. | Not optimized | | | | | 1 | 0 | 4 |
| OT2-36 | ATCTGCCACCAC CCCGCCTCAGG | 5 | | 1536. | CTGAGAGGGGGAG GGGAGG | 1537. | TCGACTGG TCTTGTCC TCCCA | 1538. | 68C Anneal, 3% DMSO | 3 | 0 | 2 |
| OT2-37 | CATCTTCCCCAC CCCGCCTCTGG | 5 | | 1539. | CAGCCTGCTGCAT CGGAAAA | 1540. | TGCAGCCA AGAGAAAA AGCCT | 1541. | 1M betaine, TD | 1 | 0 | 4 |
| OT2-38 | CTTTCCTCCAC CCAGCCTCTGG | 5 | | 1542. | TCCCTCTGACCCG GAACCCA | 1543. | ACCCGACT TCCTCCCC ATTGC | 1544. | DMSO | 2 | 1 | 2 |
| OT2-39 | GTCGAGTCCAC CCCGCCTCAGG | 5 | | 1545. | TGGGGGTTGCGTG CTTGTCA | 1546. | GCCAGGAG GACACCAG GACC | 1547. | DMSO | 4 | 1 | 0 |

TABLE E-continued

| Publication ID | Expected Off-Target Sequences - HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT2-40 | GTCGAGGTCCAC CCCGCCTCAGG | 1548. | 5 | | ATCAGGTGCCAGG AGGACAC | 1549. | GGCCTGAG AGTGGAGA GTGG | 1550. | DMSO | 4 | 1 | 0 |
| OT2-41 | TCAGACCTCCAC CCCGCCTCAGG | 1551. | 5 | | Not optimized | | | | | 1 | 4 | 0 |
| OT2-42 | TGCAACCTCCTC CCCGCCTCGGG | 1552. | 5 | | TGAGCCACATGAA TCAAGGCCTCC | 1553. | ACCTCTCC AAGTCTCA GTAACTCT CT | 1554. | DMSO | 1 | 3 | 1 |
| OT2-43 | ACCAGTCTGCAC CCCGCCTCTGG | 1555. | 6 | | GGTCCCTCTCTGC AGTGGAA | 1556. | CTTTGGTG GACCTGCA CAGC | 1557. | DMSO | 2 | 2 | 2 |
| OT2-44 | ACTACCACCTC CCCGCCTCAGG | 1558. | 6 | | GCGAGGCTGCTGA CTTCCCT | 1559. | GCTGGGAC TACAGACA TGTGCCA | 1560. | DMSO | 2 | 2 | 2 |
| OT2-45 | ATTTCCCCCCC CCCGCCTCAGG | 1561. | 6 | ATTTCCTCCCCCCC C-CCTCAGG (SEQ ID NO: 2228) | ATTGCAGGCGTGT CCAGGCA | 1562. | AAATCCTG CATGTGA TGGGAGT | 1563. | DMSO | 1 | 1 | 5 |
| OT2-46 | CCACCATCCAC CCCGCCTCTGG | 1564. | 6 | | TGCTCTGCCATTT ATGTCCTATGAAAC T | 1565. | ACAGCCTC TTCTCCAT GACTGAGC | 1566. | DMSO | 1 | 3 | 2 |
| OT2-47 | CCCAAGCCCAC CCCGCCTCGGG | 1567. | 6 | | TCCGCCCAAACAG GAGGCAG | 1568. | GCGGTGGG GAAGCCAT TGAG | 1569. | DMSO | 2 | 3 | 1 |
| OT2-48 | CCGCGCTTCCGC CCCGCCTCTGG | 1570. | 6 | | GGGGTCTGCTC ACCTGA | 1572. | CCTGTCGG GAGAGTGC CTGC | 1572. | DMSO | 3 | 1 | 2 |
| OT2-49 | CCTGCCATGCAC CCCGCCTCAGG | 1573. | 6 | | TCCTGGTTCATTT GCTAGAACTCTGG A | 1574. | ACTCCAGA TGCAACCA GGGCT | 1575. | DMSO | 3 | 2 | 1 |
| OT2-50 | CTGCCTCCTCAC CCCGCCTCAGG | 1576. | 6 | | CGTGTGGTGAGCC TGAGTCT | 1577. | GCTTCACC GTAGAGGC TGCT | 1578. | DMSO | 3 | 0 | 3 |

TABLE E-continued

| Publication ID | Expected Off-Target Sequences (Expected) - HS GRCh37 | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|
| OT2-51 | TCTTCTTTCCAC CCCGCCTCAGG | 6 | | AGGCCCTGATAAT TCATGCTACCAA | 1579. | TCAGTGAC AACCTTTT GTATTCGG CA | 1580. | 1581. DMSO | 0 | 2 | 4 |
| OT2-52 | TTGACCCCCGC CCCGCCTCAGG | 6 | | Not optimized | 1582. | | | | 2 | 2 | 2 |
| Target 3 | GGTGAGTGAGTG TGTGCGTGTGG | 0 | | TCCAGATGGCACA TTGTCAG | 1583. | AGGGAGCA GGAAAGTG AGGT | 1564. | 1565. DMSO | | | |
| OT3-1 | GGTGAGTGAGTG TGTGTGTGAGG | 1 | | GCAGGCAAGCTGT CAAGGGT | 1586. | CACCGACA CACCACT CACC | 1587. | 1588. DMSO | 0 | 0 | 1 |
| OT3-2 | A GTGAGTGAGTG TGTGTGTGAGG | 2 | | GAGGGGGAAGTCA CCGACAA | 1589. | TACCCGGG CCGTCTGT TAGA | 1590. | 1591. DMSO | 0 | 0 | 2 |
| OT3-3 | A GTGAGTGAGTG TGTGCGTGTGG | 2 | | GACACCCCACACA CTCTCATGC | 1592. | TGAATCCC TTCACCCC CAAG | 1593. | 1599. DMSO | 1 | 0 | 1 |
| OT3-9 | G CTGAGTGAGTG TATGCGTGTGG | 2 | | TCCTTTGAGGTTC ATCCCCC | 1595. | CCAATCCA GGATGATT CCGC | 1596. | 1597. DMSO | 1 | 0 | 1 |
| OT3-5 | GGTGAGTGAGTG TGTGAGTGAGG | 2 | | CAGGGCCAGGAAAC ACAGGAA | 1598. | GGGAGGTA TGTGCGGG AGTG | 1599. | 1600. DMSO | 1 | 1 | 0 |
| OT3-6 | GGTGAGTGAGAG TGTGTGTGTGG | 2 | | TGCAGCCTGAGTG AGCAAGTGT | 1601. | GCCCAGT GCTAAGCC CCTC | 1602. | 1603. DMSO | 1 | 0 | 1 |
| OT3-7 | TACAGCCTGGGTG A GTGAGTGAGG | 2 | | TACAGCCTGGGTG ATGGAGC | 1604. | TGTGTCAT GGACTTTC CCATTGT | 1605. | 1606. 1M betaine, TD | 1 | 1 | 0 |
| OT3-8 | GGTGAGTGAGTG A GTGAGTGAGG | 2 | | GGCAGGCATTAAA CTCATCAGGTCC | 1607. | TCTCCCCC AAGGTATC AGAGAGCT | 1608. | 1609. DMSO | 1 | 1 | 0 |

TABLE E-continued

| Publication ID | Expected Off-Target Sequences HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT3-9 | GGTGAGTGAGTG CGTGCCGGTGG | 1610. | 2 | | GGGCCTCCCTGCT GGTTCTC | 1611. | GCTGCCGT CCGAACCC AAGA | 1612. | DMSO | 0 | 1 | 1 |
| OT3-10 | GGTGAGTGTGTG TGTGAGTGTGG | 1613. | 2 | | ACAAACGCAGTG GACCGAA | 1614. | ACTCCGAA AATGCCCC GCAGT | 1615. | DMSO | 1 | 1 | 0 |
| OT3-11 | GGTGAGTGTGTG TGTGCATGTGG | 1616. | 2 | | AGGGGAGGGGACA TTGCCT | 1617. | TTGAGAGG GTTCAGTG GTTGC | 1618. | DMSO | 1 | 0 | 1 |
| OT3-12 | GGTGAGTGTGTG TGTGTGTGTGG | 1619. | 2 | | CTAATGCTTACGG CTGCGGG | 1620. | AGCCAACG GCAGATGC AAAT | 1621. | DMSO | 1 | 0 | 1 |
| OT3-13 | GGTGTGTGTGTG TGTGCGTGCGG | 1622. | 2 | | GAGCCGAAGTTAAC CCACCGC | 1623. | CACACATG CACATGCC CCTG | 1629. | 68C, 3% DMSO | 2 | 0 | 0 |
| OT3-14 | GGTGTGTGTGTG TGTGCGTGTGG | 1625. | 2 | | GCATGTGTCTAAC TGGAGACAATAGC A | 1626. | TCCCCCAT ATCAACAC ACACA | 1627. | DMSO | 2 | 0 | 0 |
| OT3-15 | GGTGTGTGTGTG TGTGCGTGTGG | 1628. | 2 | | GCCCCTCCCGCCT TTTGTGT | 1629. | TGGGCAAA GGACATGA AACAGACA | 1630. | DMSO | 2 | 0 | 0 |
| OT3-16 | GGTGTGTGTGTG TGTGCGTGTGG | 1631. | 2 | | GCCTCAGCTCTGC TCTTAAGCCC | 1632. | ACGAACAG ATCATTTT TCATGGCT TCC | 1633. | DMSO | 2 | 0 | 0 |
| OT3-17 | GTTGAGTGAATG TGTGCGTGAGG | 1634. | 2 | | CTCCAGAGCCTGG CCTACCA | 1635. | CCCTCTCC GGAAGTGC CTTG | 1636. | DMSO | 0 | 1 | 1 |
| OT3-18 | TGTGGGTGAGTG TGTGCGTGAGG | 1637. | 2 | | TCTGTCACCACAC AGTTACCACC | 1638. | GTTGCCTG GGGATGGG GTAT | 1639. | DMSO | 0 | 1 | 1 |
| OT3-19 | ACTGTGTGAGTG TGTGCGTGAGG | 1640. | 3 | | GGGGACCCTCAAG AGGCACT | 1691. | GGGCATCA AAGGATGG GGAT | 1642. | DMSO | 2 | 0 | 1 |

TABLE E-continued

| Publication ID | Expected Off-Target Sequences (Expected) - HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT3-20 | AGAGAGTGAGTG TGTGCATGAGG | 1643. | 3 | | TGTGGAGGGTGGG ACCTGGT | 1694. | ACAGTGAG GTGCGGTC TTTGGG | 1645. | DMSO | 1 | 0 | 2 |
| OT3-21 | AGCGAGTGGGTG TGTGCGTGTGG | 1646. | 3 | | CGGGGTGGCAGTG ACGTCAA | 1697. | GGTGCAGT CCAAGAGC CCCC | 1698. | DMSO | 0 | 0 | 3 |
| OT3-22 | AGGGAGTGACTG TGTGCGTGTGG | 1649. | 3 | | AGCTGAGGCAGAG TCCCCGA | 1650. | GGGAGACA GAGCAGCG CCTC | 1651. | DMSO | 1 | 1 | 1 |
| OT3-23 | AGTGAGTGAGTG AGTGAGTGAGG | 1652. | 3 | | ACCACCAGACCCC ACCTCCA | 1653. | AGGACGAC TTGTGCCC CATTCA | 1659. | 72C Anneal, 3% DMSO | 1 | 1 | 1 |
| OT3-24 | CATGAGTGAGTG TGTGGGTGGGG | 1655. | 3 | | GCGTCAGGACGCA GGTCAGA | 1656. | TCCACCCA CCCACCCA TCCT | 1657. | 72C Anneal, 3% DMSO | 2 | 0 | 1 |
| OT3-25 | CGTGAGTGTGTG TATGCGTGTGG | 1658. | 3 | | ACACTCTGGGCTA GGTGCTGGA | 1661. | GCCCCCTC ACCACATG ATGCT | 1660. | DMSO | 2 | 0 | 1 |
| OT3-26 | GGACTGTGAGTG TGTGCGTGTGG | 1661. | 3 | | GGGGCCATTCCTC TGCTGCA | 1662. | TGGGGATC CTTGCTCA TGGC | 1663. | DMSO | 3 | 0 | 0 |
| OT3-27 | GGTGTGTGCCTG TGTGCGTGTGG | 1664. | 3 | | ACACACTGGCTCG CATTCACCA | 1665. | CCTGCACG AGGCCAGG TGTT | 1666. | DMSO | 2 | 1 | 0 |
| OT3-28 | GTTTCATGAGTG TGTGCGTGTGG | 1667. | 3 | | TGGGCACGTAGTA AACTGCACCA | 1668. | CTCGCCGC CGTGACTG TAGG | 1669. | DMSO | 0 | 3 | 1 |
| OT3-29 | TGAGTGTGAGTG TGTGCGTGTGG | 1670. | 3 | | TCAGCTGGTCCTG GGCTTGG | 1672. | AGAGACT GGGTAGCA GTCAGT | 1672. | DMSO | 2 | 1 | 0 |
| OT3-30 | TGCCAGTGAGTG TGTGCGTGTGG | 1673. | 3 | | AGACACAGCCAGG GCCCTCAG | 1674. | GGTGGGCG TGTGTGTG TACC | 1675. | 68C, 3% DMSO | 1 | 1 | 1 |

TABLE E-continued

| Publication ID | Expected Off-Target Sequences HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT3-31 | TGGGTGTGAGTG TGTGCGTGTGG | 1676. | 3 | | ACACTCTCACACA CGCACCAA | 1677. | GAGAAGTC AGGGCTGG CGCG | 1678. | 72C Anneal, 3% DMSO | 1 | 2 | 0 |
| OT3-32 | TGTATGTGAGTG TGTGCGTGTGG | 1679. | 3 | | ACTGCCTGCATTT CCCCGGT | 1680. | TGGTGAGG GCTTCAGG GAGC | 1681. | DMSO | 1 | 1 | 1 |
| OT3-33 | TGTGAGAGAGAG TGTGCGTGTGG | 1682. | 3 | | GCCAGGTTCATTG ACTGCCC | 1683. | TCCTTCTA CACATCGG CGGC | 1684. | DMSO | 2 | 1 | 0 |
| OT3-34 | TGTGCCTGAGTG TGTGCGTGTGG | 1685. | 3 | | CGAGGGAGCCGAG TTCGTAA | 1686. | CTGACCTG GGGCTCTG GTAC | 1687. | DMSO | 1 | 2 | 0 |
| OT3-35 | TGTGTGTGTGTG TGTGCGTGTGG | 1688. | 3 | | TCCTCGGGAAGTC ATGGCTTCA | 1689. | GCACTGAG CAACCAGG AGCAC | 1690. | DMSO | 2 | 1 | 0 |
| OT3-36 | AGCGTGTGAGTG TATGCGTGGGG | 1691. | 4 | | Not optimized | | | | | 1 | 0 | 3 |
| OT3-37 | ATTGAGTGTGTG AGTGCGTGGGG | 1692. | 4 | | TAAACCGTTGCCC CCGCCTC | 1693. | GCTCCCCT GCCAGGTG AACC | 1694. | DMSO | 2 | 1 | 1 |
| OT3-38 | CATGTGTGGGTG TGTGCGTGTGG | 1695. | 4 | | CCTGCTGAGACTC CAGGTCC | 1696. | CTGCGGAG TGGCTGGC TATA | 1697. | DMSO | 2 | 0 | 2 |
| OT3-39 | CCCGAGTGTGTG TGTGCGTGTGG | 1698. | 4 | | CTCGGGGACTGAC AAGCCGG | 1699. | GGAGCAGC TCTTCCAG GGCC | 1700. | DMSO | 3 | 0 | 1 |
| OT3-40 | CTGGAGTGTGTG TGTGCGTGTGG | 1701. | 4 | | CCCCGACCAAAGC AGGAGCA | 1702. | CTGGCAGC CTCTGGAT GGGG | 1703. | DMSO | 1 | 2 | 1 |
| OT3-41 | GTTTCATGAGTG TGTGCGTGGGG | 1704. | 4 | | Not optimized | | | | | 0 | 3 | 1 |

TABLE E-continued

| Publication ID | Expected Off-Target Sequences - HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT3-42 | TATGTGTGCGTGTGTGCGTGTGG | 1705. | 4 | | ATTTCAGAGCCCCGGGGAAA | 1706. | AGGCCGCGGTGTTATGGTTA | 1707. | DMSO | 1 | 2 | 1 |
| OT3-43 | TATGTGTGTGTGTGTGCGTGTGG | 1708. | 4 | | GCCAGTGGCTTAGTGTCTTTGTGT | 1709. | TGACATATTTTCCTGGGCCATGGGT | 1710. | DMSO | 2 | 1 | 1 |
| OT3-44 | TCTGTGTGTGTGTGTGCGTGTGG | 1711. | 4 | | TGCCAGAAGAACATGGGCCAGA | 1712. | CCATGCTGACATCATATACTGGGAAGC | 1713. | DMSO | 3 | 1 | 0 |
| OT3-45 | TCTGTGTCTGTGTGTGCGTGTGG | 1714. | 4 | | GCGTGTCTCTGTGTGCGTGC | 1715. | CCAGGCTGGGCACACAGGTT | 1716. | DMSO | 3 | 1 | 0 |
| OT3-46 | TGAGCGTGAGTGTGAGCGTGTGG | 1717. | 4 | | Not optimized | | | | | 2 | 2 | 0 |
| OT3-47 | TGTCTTTGAGTGTGTGCGTGTGG | 1718. | 4 | | TGCCCAGTCCAATATTTCAGCAGCT | 1719. | AGGATGAGTTCATGTCCTTTGTGGG | 1720. | DMSO | 2 | 2 | 0 |
| OT3-48 | TTTGTGTGTGTGTGTGCGTGTGG | 1721. | 4 | | GGGTGAAAATTTGGTACTGTTAGCTGT | 1722. | AATGACTCATTCCCTGGGTATCTCCCA | 1723. | DMSO | 2 | 2 | 0 |
| OT3-49 | AAGGCGTGTGTGTGTGCGTGTGG | 1724. | 5 | | TGCCCCATCAATCACCTCGGC | 1725. | CAAGGTCGGCAGGGCAGTGA | 1726. | DMSO | 1 | 2 | 2 |
| OT3-50 | AATTCGTGTGTGTGTGCGTGGGG | 1727. | 5 | | GCCTCCTCTGCCGCTGGTAA | 1728. | TGAGAGTTCCTGTTGCTCCACACT | 1729. | DMSO | 1 | 2 | 2 |
| OT3-51 | ATGTCGTGTGTGTGTGCGTGTGG | 1730. | 5 | | Not optimized | | | | | 2 | 2 | 1 |
| OT3-52 | CACGTGTGTGTGTGTGCGTGTGG | 1731. | 5 | | GCCACCAAAATAGCCAGCGT | 1732. | ACATGCATCTGTGTGCGT | 1733. | DMSO | 3 | 0 | 2 |

TABLE E-continued

| Publication ID | Expected Off-Target Sequences HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT3-53 | GAAATTTGAGTGTGTGCGTGTGG | 1734. | 5 | | ACAGACTGACCCTTGAAAATACCAGT | 1735. | TGTATCTTTCTTGCCAATGGTTTTCCC | 1736. | DMSO | 2 | 1 | 2 |
| OT3-54 | TAAGTGTGTGTGTGTGCGTGTGG | 1737. | 5 | | AGCCAAATTTCTCAACAGCAGCACT | 1738. | TCCTGGAGAGCAGGCATTTTTGT | 1739. | DMSO | 3 | 1 | 1 |
| OT3-55 | TATATGTGTGTGTGTGCGTGGGG | 1740. | 5 | | ACCTCCTTGTGCTGCCTGGC | 1741. | GGCGGGAAGGTAACCCTGGG | 1742. | DMSO | 2 | 1 | 2 |
| OT3-56 | TAICTGTGTGTGTGTGCGTGTGG | 1743. | 5 | | CACAAAGCTCACCTTTCCAGTAGTGT | 1744. | TGATCCGATGGTTGTTCACAGCT | 1745. | DMSO | 3 | 1 | 1 |
| OT3-57 | TTTATGTGTGTGTGTGCGTGTGG | 1746. | 5 | | TGTGGGGATTACCTGCCTGGC | 1747. | ACGCACAAAAATGCCCTTGTCA | 1748. | DMSO | 2 | 2 | 1 |
| OT3-58 | TTTTTGTGTGTGTGTGCGTGGGG | 1749. | 5 | | TGAGGCAGACCAGTCATCCAGC | 1750. | GCCCGAGCACAGTGTAGGGC | 1751. | DMSO | 2 | 3 | 0 |
| OT3-59 | AAAAATGTGTGTGTGCGTGGGG | 1752. | 6 | | ATTAGCTGGGCGTGGCGGAG | 1753. | ACTGCATCTCATCTCAGGCAGCT | 1754. | DMSO | 2 | 1 | 3 |
| OT3-60 | ACAATGTGTGTGTGTGCGTGTGG | 1755. | 6 | | TGAAGCAGAAGGAGTGAGAAGGA | 1756. | TCAGCTTCACATCTGTTTCAGTTCAGT | 1757. | DMSO | 4 | 0 | 2 |
| OT3-61 | ATGTGTGTGTGTGTGCGTGTGG | 1758. | 6 | | TGGTTGGAGTGTGTGTGTGGT | 1759. | AGAGCAGAAAGAGAGTGCCCA | 1760. | DMSO | 1 | 3 | 2 |
| OT3-62 | CAAAATGTGTGTGTGCGTGTGG | 1761. | 6 | | GCCCCTGTACGTCCTGACAGC | 1762. | TGCACAAGCCACTTAGCCTCTCT | 1763. | DMSO | 3 | 1 | 2 |
| OT3-63 | CCCTGTGTGTGTGTGCGTGTGG | 1764. | 6 | | AGCGCAGTAAACAGGCCCA | 1765. | TCTCTCGCCCGTTTCCTTGT | 1766. | DMSO | 3 | 1 | 2 |

TABLE E-continued

| Publication ID | Expected Off-Target Sequences (Expected) - HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT3-64 | TCCGCTTGTGTGTGCGTGGGG | 1767. | 6 | | ATGGGTGCCAGGTACCACGC | 1768. | ACAGCAGGAAGGAGCCGCAG | 1769. | DMSO | 2 | 3 | 1 |
| OT3-65 | TCCTCTGGTGTGTGCGTGGGG | 1770. | 6 | | CGGGCGGGTGGACAGATGAG | 1771. | AGGAGGTCTCAGCCAGGGGG | 1772. | DMSO | 2 | 3 | 1 |
| OT3-66 | TTAAGGGTGGTGTGCGTGGGG | 1773. | 6 | | TCAACCTAGTGAACACAGACCACTGA | 1774. | GTCTATATACAGCCCACAACCTCATGT | 1775. | DMSO | 1 | 2 | 3 |
| OT3-67 | TTTATATTGTGTGTGCGTGGGG | 1776. | 6 | | GCCAGGGCCAGTGGATTGCT | 1777. | TGTCATTTCTTAGTATGTCAGCCGGA | 1778. | DMSO | 2 | 4 | 0 |
| OT3-68 | TTGAGGAGAGTGTGTGCGTGAGG | 1779. | 6 | | GAGCCCCACCGGTTCAGTCC | 1780. | GCCAGAGCTACCCACTCGCC | 1781. | DMSO | 1 | 3 | 2 |
| Target 4 | GAGTCCGAGCAGAAGAAGAAGGG | 1782. | | | | 1783 | | 1784. | | | | |
| OT4-1 | GAGTTAGAGCAGAGGAAGAAAGG | 1785. | 0 | | GGAGCAGCTGGTCAGAGGGG | 1786. | GGGAAGGGGGACACTGGGGA | 1787. | DMSO | 0 | 1 | 1 |
| OT4-2 | AAGTCAGAGCAGAAGAAGAAGGG | 1788. | 2 | AAGACAGAGGAGAAGAAGAAGGG (SEQ ID NO: 2229) | TCTCTCCTTCAACTCATGACCAGCT | 1789. | ATCTGCACATGTATGTACAGGAGTCAT | 1790. | DMSO | 2 | 1 | 1 |
| OT4-3 | AAGTCCGAGGAGAAGAAGAAGGG | 1791. | 3 | | TGGGGAATCTCCAAAGAACCCCC | 1792. | AGGGTGTACTGTGGGAACTTTGCA | 1793. | DMSO | 1 | 0 | 2 |
| OT4-4 | AAGTCCGAGGAGAGGAAGAAGGG | 1794. | 3 | | GATGGCCCCACTGAGCACGT | 1795. | ACTTCGTAGAGCCTTAAACATGTGC | 1796. | DMSO | 1 | 0 | 2 |
| | AAGTCTGAGCACAAGAAGAATGG | 1797. | 3 | | AGGATTAATGTTTAAAGTCACTGGTGG | 1798. | TCAAACAAGGTGCAGATACAGCA | 1799. | 1M betaine, TD | | | |

TABLE E-continued

| Publication ID | Expected Off-Target Sequences (Expected) - HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT4-5 | A CGTCTGAGCAG AAGAAGAATGG | 1800. | 3 | | TCCAAGCCACTGG TTTCTCAGTCA | 1801. | TGCTCTGT GGATCATA TTTTGGGG GA | 1802. | DMSO | 0 | 1 | 2 |
| OT4-6 | GA CTCCTAGCAA AAGAAGAATGG | 1803. | 3 | | ACTTTCAGAGCTT GGGGCAGGT | 1804. | CCCACGCT GAAGTGCA ATGGC | 1805. | DMSO | 1 | 1 | 1 |
| OT4-7 | GAGA CTGAGAAG AAGAAGAAAGG | 1806. | 3 | | CAAAGCATGCCTT TCAGCCG | 1807. | GGCTCTTC GATTTGGC ACCT | 1808. | 1M betaine, TD | 1 | 1 | 1 |
| OT4-8 | GAGCC GGAGCAG AAGAAGAGGG | 1809. | 3 | | Not optimized | | | | | 1 | 0 | 2 |
| OT4-9 | GAGCCT GAGCAG AAGGAGAAGGG | 1810. | 3 | | GGACTCCCCTGCAG CTCCAGC | 1811. | AGGAACAC AGGCCAGG CTGG | 1812. | 72C Anneal, 6% DMSO | 0 | 0 | 3 |
| OT4-10 | GAGG CCGAGCAG AAGAAGAACGG | 1813. | 3 | | CCCTTTAGGCACC TTCCCCA | 1814. | CCGACCTT CATCCCTC CTGG | 1815. | DMSO | 0 | 1 | 2 |
| OT4-11 | GAGTAAG AGAAG AAGAAGAAGGG | 1816. | 3 | | TGATTCTGCCTTA GAGTCCCAGT | 1817. | TGGGCTCT GTGTCCCT ACCCA | 1818. | DMSO | 0 | 3 | 0 |
| OT4-12 | GAGT AGGAGGAG AAGAAGAAAGG | 1819. | 3 | | Not optimized | | | | | 2 | 1 | 0 |
| OT4-13 | GAGTCC CGGAAG GAGAAGAAAGG | 1820. | 3 | | AGGAGGAGAGCA AGCAGGT | 1821. | ACCCTGAC TACTGACT GACCGCT | 1822. | DMSO | 0 | 1 | 2 |
| OT4-14 | GATTCC TACCAG AAGAAGAATGG | 1823. | 3 | | CTCCCCATTGCGA CCCGAGG | 1824. | AGAGGCAT TGACTTGG AGCACCT | 1825. | DMSO | 1 | 2 | 0 |
| OT4-15 | GCG ACAGAGCAG AAGAAGAGGG | 1826. | 3 | | CTGGAGCCCCAGCA GGAAGGC | 1827. | CCTCAGGG AGGGGCC TGAT | 1828. | DMSO | 1 | 2 | 0 |

TABLE E-continued

| Publication ID | Expected Off-Target Sequences (Expected) - HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT4-16 | AAATCCAACCAG AAGAAGAAAGG | 1829. | 4 | | ACTGTGGGCGTTG TCCCCAC | 1830. | AGGTCGT GCAGGGTT TAAGGA | 1831. | DMSO | 1 | 0 | 3 |
| OT4-17 | AAGTCTGAGGAC AAGAAGAATGG | 1832. | 4 | | GGCGCTCCCTTTT TCCCTTTGT | 1833. | CGTCACCC ATCGTCTC GTGGA | 1834. | DMSO | 2 | 0 | 2 |
| OT4-18 | AAGTTGGAGCAG GAGAAGAAGGG | 1835. | 4 | | TGCCATCTATAGC AGCCCCT | 1836. | GCATCTTG CTAACCGT ACTTCTTC TGA | 1837. | DMSO | 1 | 0 | 3 |
| OT4-19 | AATACAGAGCAG AAGAAGAATGG | 1838. | 4 | | GTGAGAGACGCTAA ACCTGTGAGT | 1839. | GCTCCTGG CCTCTTCC TACAGC | 1840. | DMSO | 1 | 2 | 1 |
| OT4-20 | AGGTACTAGCAG AAGAAGAAAGG | 1841. | 4 | | CCGAACTTCTGCT GAGCTTGATGC | 1842. | CCAAGTCA ATGGGCAA CAAGGGA | 1843. | DMSO | 0 | 2 | 2 |
| OT4-21 | AGGTGTAGCAG AAGAAGAAGGG | 1844. | 4 | | Not optimized | | | | | 1 | 1 | 2 |
| OT4-22 | AGGTGGGAGCAG AAGAAGAAGGG | 1845. | 4 | | TGCCCCAAGACC TTTCTCC | 1846. | ATGGCAGG CAGAGGAG GAAC | 1847. | DMSO | 2 | 0 | 2 |
| OT4-23 | CAAACCGAGCAG AAGAAGAAAGG | 1848. | 4 | | GGGTGGGGCCATT GTGGGTT | 1849. | CTGGGGCC AGGGTTTC TGCC | 1850. | DMSO | 3 | 0 | 1 |
| OT4-24 | CACTCTGAGGAG AAGAAGAAAGG | 1851. | 4 | | TGGAGAACATGAG AGGCTTGCAA | 1852. | TCCTTCTG TAGGCAAT GGGAACAA | 1853. | DMSO | 3 | 0 | 1 |
| OT4-25 | CAGTCATGGCAG AAGAAGAAAGG | 1854. | 4 | | GCCACATGGTAGA AGTCGGC | 1055. | GGCAGATT TCCCCCAT GCTG | 1856. | 1M betaine, TD | 1 | 2 | 1 |
| OT4-26 | CCGTCCCAGCAG TAGAAGAATGG | 1857. | 4 | | TGTACACCCCAAG TCCTCCC | 1858. | AAGGGGAG TGTGCAAG CCTC | 1859. | DMSO | 3 | 1 | 0 |

TABLE E-continued

| Publication ID | Expected Off-Target Sequences (Expected) - HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT4-27 | GTCTGGGATCAGAAGAAGAAGG | 1860. | 4 | | AGGTCTGGCTAGAGATGCAGCA | 1861. | AGTCCAACACTCAGGTGAGACCCT | 1862. | DMSO | 3 | 1 | 0 |
| OT4-28 | TAATCCAATCAGAAGAAGAAGGG | 1863. | 4 | | CCAAGAGGACCCAGCTGTTGGA | 1864. | GGGTATGGAATTCTGGATTAGCAGAGC | 1865. | DMSO | 0 | 2 | 2 |
| OT4-29 | TATACGGAGCAGAAGAAGATGG | 1866. | 4 | | ACCATCTCTTCATTGATGAGTCCCAA | 1867. | ACACTGTGAGTATGCTTGGCGT | 1868. | DMSO | 2 | 2 | 0 |
| OT4-30 | ACTTCCCTGCAGAAGAAGAAGG | 1869. | 5 | | GGCTGCGGGGAGATGAGCTC | 1870. | TCGGATGCTTTTCCACAGGGCT | 1871. | DMSO | 2 | 2 | 1 |
| OT4-31 | AGGACTGGGCAGAAGAAGGG | 1872. | 5 | | TCTTCCAGGAGGGCAGCTCC | 1873. | CCAATCCTGAGCTCCTACAAGCT | 1874. | DMSO | 1 | 0 | 4 |
| OT4-32 | AGGTTGGAGAAGAAGAAGGG | 1875. | 5 | | GAGCTGCACTGGATGGCACT | 1876. | TGCTCGTTAAGGGGTGTTTTGGA | 1877. | DMSO | 1 | 1 | 3 |
| OT4-33 | AGTTCAGAGCAGGAGAAGATGG | 1878. | 5 | | TCTGGGAAGGTGAGGAGCCA | 1879. | TGGGGGACAATGAAAAGCAATGA | 1880. | DMSO | 0 | 2 | 3 |
| OT4-34 | ATGACACAGCAGAAGAAGAGG | 1881. | 5 | | CTTGCTCCCAGCCTGACCCC | 1882. | AGCCCTTGCCATGCAGGACC | 1883. | DMSO | 3 | 1 | 1 |
| OT4-35 | ATGACAGAGAAGAAGAAGG | 1884. | 5 | | GGGATTTTTATCTGTTGGGTGCGAA | 1885. | AACCACAGATGTACCCTCAAAGCT | 1886. | DMSO | 2 | 2 | 1 |
| OT4-36 | CCGCCCCTGCAGAAGAAGACGG | 1887. | 5 | | ACCCATCAGGACCGCAGCAC | 1888. | TCTGGAACCTGGGAGGCGGA | 1889. | 72C Anneal, 3% DMSO | 3 | 1 | 1 |
| OT4-37 | GCAGGAGAGCAGAAGAAGAAGG | 1890. | 5 | | CGTCCCCTCACAGCCAGCCTC | 1891. | CCTCCTTGGGCCTGGGGTTC | 1892. | DMSO | 1 | 3 | 1 |

TABLE E-continued

| Publication ID | Expected Off-Target Sequences (Expected) - HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT4-38 | GTTCAAGAGCAG AAGAAGAATGG | 1893. | 5 | | CCCTCTGCAAGGT GGAGTCTCC | 1894. | AGATGTTC TGTCCCCA GGCCT | 1895. | DMSO | 1 | 3 | 1 |
| OT4-39 | GTTTTGAAGCAG AAGAAGAAAGG | 1896. | 5 | | GGCTTCCACTGCT GAAGGCCT | 1897. | TGCCGCTC CACATACC CTCC | 1898. | DMSO | 2 | 1 | 2 |
| OT4-40 | TATGGCAAGCAG AAGAAGAAAGG | 1899. | 5 | | AGCATTGCCTGTC GGGTGATGT | 1900. | AGCACCTA TTGGACAC TGGTTCTC T | 1901. | DMSO | 1 | 3 | 1 |
| OT4-41 | TGGTGGGATCAG AAGAAGAAAGG | 1902. | 5 | | TCTAGAGACAGGGG CACAATGC | 1903. | TGGAGATG GAGCCTGG TGGGA | 1909. | DMSO | 2 | 2 | 1 |
| OT4-42 | ACCCACGGGCAG AAGAAGAAGGG | 1905. | 6 | | GGTCTCAGAAAAT GGAGAGAAGCAC G | 1906. | CCCACAGA AACCTGGG CCCT | 1907. | DMSO | 1 | 2 | 3 |
| OT4-43 | ACTCCTGATCAG AAGAAGAAAGGG | 1908. | 6 | | GGTTGCTGATACC AAACGTTTGCCT | 1909. | TGGGTCCT CTCCACCT CTGCA | 1910. | DMSO | 0 | 3 | 3 |
| OT4-44 | ACTGATGAGCAG AAGAAGAAAGG | 1911. | 6 | | ACTCTCCTTAAGT ACTGATATGGCTG T | 1912. | CAGAATCT TGCTCTGT TGCCCA | 1913. | DMSO | 0 | 4 | 2 |
| OT4-45 | ATTTTAGTGCAG AAGAAGAAAGG | 1914. | 6 | | Not optimized | | | | | 2 | 2 | 2 |
| OT4-46 | ATTTTAGTGCAG AAGAAGAAAGG | 1915. | 6 | | Not optimized | | | | | 2 | 2 | 2 |
| OT4-47 | CCATGGCAGCAG AAGAAGAGGG | 1916. | 6 | | CAATGCCTGCAGT CCTCAGGA | 1917. | TCCCAAGA GAAAACTC TGTCCTGA CA | 1918. | DMSO | A | 1 | 1 |
| OT4-48 | CCATTACACAGCAG AAGAAGAAGGG | 1919. | 6 | | GCATTGGCTGCCC AGGGAAA | 1920. | TGGCTGTG CTGGGCTG TGTT | 1921. | DMSO | 2 | 2 | 2 |

TABLE E-continued

| Publication ID | Expected Off-Target Sequences (Expected) - HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT4-49 | CGAGGCGGGCAG AAGAAGAAAGG | 1922. | 6 | | CCACAAGCCTCAG CCTACCCG | 1923. | ACAGTGC CAAACAC TGCCT | 1924. | DMSO | 2 | 1 | 3 |
| OT4-50 | TCATTGCAGCAG AAGAAGAAAGG | 1925. | 6 | TCATTGCAGCAGAA GAAGAAAGG TCATTGTAGCAGAA GAAGAAAGG (SEQ ID NO: 2230) | GCCTCTTGCAAAT GAGACTCCTTTT | 1926. | CGATCAGT CCCCTGGC GTCC | 1927. | DMSO | 2 / 1 | 2 / 3 | 2 |
| OT4-51 | TCTCCAGGGCAG AAGAAGAAAGG | 1928. | 6 | | TCCCAGAATCTGC CTCCGCA | 1929. | AGGGGTTT CCAGGCAC ATGGG | 1930. | DMSO | 0 | 4 | 2 |
| | | 1931. | | | | 1932. | | 1933. | | | | |
| Target 5 | GTCATCTTAGTC ATTACCTGAGG | 1934. | 0 | | TCCTAAAATCAG TTTTGAGATTTAC TTCC | 1935. | AAAGTGTT AGCCAACA TACAGAAG TCAGGA | 1936. | DMSO | | | |
| OT5-1 | GGTATCTTAGTC ATTACCTGTGG | 1937. | 3 | GGTATCTTAAGTCAT TACCTGTGG (SEQ ID NO: 2231) GGTATCTTAAGTCAA TACCTGTGG (SEQ ID NO: 2232) | ACATCTGGGAAA GCAAAAGTCAACA | 1938. | TGTCTGAG TATCTAGG CTAAAGT GGT | 1939. | DMSO | 1 / 2 | 1 | 1 |
| OT5-2 | GTAATATTAGTC ATTACCGGTGG | 1940. | 3 | | ACGATCTTGCTTC ATTTCCCTGTACA | 1941. | AGTGCTTT GTGAACTG AAAAGCAA | 1942. | DMSO | 0 | 3 | 0 |
| OT5-3 | GTAATCTTGAGTC ATTTCCTGGGG | 1943. | 3 | | GCACCTTGGTGCT GCTAAATGCC | 1944. | ACA GGGCAACT GAACAGGC ATGAATGG | 1945. | DMSO | 1 | 2 | 0 |
| OT5-4 | GTCATCCTAGTC ATTTACTGGGG | 1946. | 3 | | AACTGTCTGCAT CCCCCCC | 1947. | GGTGCACC TGGATCCA CCCA | 1948. | DMSO | 1 | 1 | 1 |
| OT5-5 | GTCATCCTAGTG CTTACCTGAGG | 1949. | 3 | | Not optimized | 1950. | | 1951. | | | | 1 |

TABLE E-continued

| Publication ID | Expected Off-Target Sequences (Expected) - HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT5-6 | GTCATCTGAGGC ATTAACTGGGG | 1952. | 3 | | CATCACCCTCCAC CAGGCCC | 1953. | ACCACTGC TGCAGGCT CCAG | 1954. | 72C Anneal, 3% DMSO | 0 | 3 | 0 |
| OT5-7 | AATATGTTAGTC ATTACCTGAGG | 1955. | 4 | | Not optimized | | | | | 2 | 0 | 2 |
| OT5-8 | ATAAACGTAGTC ATTACCTGGGG | 1956. | 4 | | CCTGACCCGTGGT TCCCGAC | 1957. | TGGTGCGT GGTGTGTG TGGT | 1958. | 72C Anneal, 3% DMSO | 1 | 2 | 1 |
| OT5-9 | ATCATCATCGTC ATTATCTGTGG | 1959. | 4 | | TGGGAACATTGGA GAAGTTCCTGA | 1960. | CCATGTGA CTACTGGG CTGCCC | 1961. | DMSO | 1 | 1 | 2 |
| OT5-10 | ATCATTTTACTC ATTACTGTGG | 1962. | 4 | | AGCCTTGGCAAGC AACTCCCT | 1963. | GGTTCTCT CTCTCAGA AAAGAAAG AGG | 1964. | DMSO | 1 | 0 | 3 |
| OT5-11 | ATCATTTTAGTC ATCTCCTGTGG | 1965. | 4 | | GGCAGCGGACTTC AGAGCCA | 1966. | GCCAGAGG CTCTCAGC AGTGC | 1967. | DMSO | 1 | 0 | 3 |
| OT5-12 | CACAGCTTAGTC ATCACCTGGGG | 1968. | 4 | | CCAGCCTGGTCAA TATGCA | 1969. | ACTGTGCC CAGCCCCA TATT | 1970. | DMSO | 2 | 1 | 1 |
| OT5-13 | CCCAGCTTAGTC ATTAGCTGTGG | 1971. | 4 | | ATGCCAACACTCG AGGGGCC | 1972. | CGGGTTGT GGCACCGG GTTA | 1973. | DMSO | 2 | 1 | 1 |
| OT5-14 | CTCACCTTTGTC ATTTCCTGAGG | 1974. | 4 | | TTGCTCTAGTGGG GAGGGGG | 1975. | AGAGTTCA GGCATGAA AAGAAGCA ACA | 1976. | DMSO | 3 | 0 | 1 |
| OT5-15 | CTCATTTTATTC ATTGCCTGGGG | 1977. | 4 | | AGCTGAAGATAGC AGTGTTAAGCCT | 1978. | TGCAATTT GAGGGGCT CTCTTCA | 1979. | DMSO | 1 | 1 | 2 |

TABLE E-continued

| Publication ID | Expected Off-Target Sequences (Expected) - HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT5-16 | CTCTCCTTAGTC ACTACCTGAGG | 1980. | 4 | | AGTCACTGGAGTA AGCCTGCCT | 1981. | TGCCAGCC AAAAGTTG TTAGTGTG T | 1982. | DMSO | 2 | 0 | 2 |
| OT5-17 | CTTATCTCTGTC ATTACCTGGGG | 1983. | 4 | | GGGTCTCCCTCAG TGCCCTG | 1984. | TGTGTGT AGGGAGCA AAACGACA | 1985. | DMSO | 2 | 0 | 2 |
| OT5-18 | GACAGTCCGTC ATTACCTGGGG | 1986. | 4 | | TGGGGGCTGTTAA GAGGCACA | 1987. | TGACCACA CACACCCC CACG | 1988. | DMSO | 1 | 2 | 1 |
| OT5-19 | GCCACTCAGTC ATTAGTGGGG | 1989. | 4 | | TCAAAACAGATTG ACCAAGGCCAAAT | 1990. | TGTGTTTT TAAGCTGC ACCCCAGG | 1991. | DMSO | 1 | 0 | 3 |
| OT5-20 | GGAATCTTACTC ATTACTTGGGG | 1992. | 4 | | TCTGGCACCAGGA CTGATTGTACA | 1993. | GCACGCAG CTGACTCC CAGA | 1994. | DMSO | 1 | 2 | 1 |
| OT5-21 | GTGGCCTCAGTC ATTACCTGGGG | 1995. | 4 | | Not optimized | | | | | 1 | 0 | 3 |
| OT5-22 | GTTGTTTTAGTG ATTACCTGAGG | 1996. | 4 | | AGCATCTGTGATA CCCTACCTGTCT | 1997. | ACCAGGGC TGCCACAG AGTC | 1998. | DMSO | 1 | 0 | 3 |
| OT5-23 | TACATCTTAGTC CTCACCTGTGG | 1999. | 4 | | TAGTCTTGTTGCC CAGGCTG | 2000. | CTCGGCCC CTGAGAGT TCAT | 2001. | DMSO | 1 | 2 | 1 |
| OT5-24 | TCCATCTCACTC ATTACCTGAGG | 2002. | 4 | TCCATCTCACTCAT TACCTGAGG (SEQ ID NO: 2233) TCCATCTCACTCAT TACCTGATG (SEQ ID NO: 2234) | CTGCAACCAGGGC CCTTACC | 2003. | GAGCAGCA GCAAAGCC ACCG | 2004. | DMSO | 1 | 1 | 2 |
| OT5-25 | TTCATCCTAGTC AACACCTGGGG | 2005. | 4 | | GCCTGGAGAGCAA GCCTGGG | 2006. | AGCCGAGA CAATCTGC CCCG | 2007. | DMSO | 1 | 1 | 2 |

TABLE E-continued

| Publication ID | Expected Off-Target Sequences HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | Watson-Crick Transversions | non-Watson-Crick Transversions | Transitions |
|---|---|---|---|---|---|---|---|---|---|---|---|---|---|
| OT5-26 | TTTATATTAGTGATTACCTGTGG | 2008. | 4 | TTTATATTAGTGATTACCTGCGG (SEQ ID NO: 2235) | AGTGAAACAAACAAGCAGCAGTCTGA | 2009. | GGCAGTCTGACCAGTGGGG | 2010. | No DMSO TD | 1 | 2 | 1 |
| OT5-27 | AACGTGTAAGTCATTACCTGAGG | 2011. | 5 | | AGGCTCAGAGAGGTAAGCAATGGA | 2012. | TGAGTAGACAGAAATGTTACCCGTGTT | 2013. | DMSO | 3 | 0 | 2 |
| OT5-28 | AAGATCACAGTCATTACCTGGGG | 2014. | 5 | | TCAGAGATGTTAAAGCCTTGGTGGG | 2015. | AGTGAACCAAGGGAATGGGGGA | 2016. | DMSO | 3 | 0 | 2 |
| OT5-29 | AGAAATATTAGTCCTTACCTGGGG | 2017. | 5 | | TGTGCTTTCTGGGGTAGTGGCA | 2018. | CACCTCAGCCCTGTAGTCCTGG | 2019. | DMSO | 0 | 4 | 1 |
| OT5-30 | AGCAGATTAGTGATTACCTGGGG | 2020. | 5 | | CCATTGGGTGACTGAATGCACA | 2021. | GCCACTGTCCCCAGCCTATT | 2022. | 1M betaine, TD | 1 | 3 | 1 |
| OT5-31 | AGTAGCTTAGTGATTACCTGGGG | 2023. | 5 | | ACCAAGAAAGTGAAAAGAAACCC | 2024. | TGAGATGGCATACGATTTACCCA | 2025. | DMSO | 1 | 2 | 2 |
| OT5-32 | CACGGCTTACTCATTACCTGGGG | 2026. | 5 | | AGGGTGGGACTGAAAGGAGCT | 2027. | TGGCATCACTCAGAGATTGGAACACA | 2028. | DMSO | 3 | 1 | 1 |
| OT5-33 | CATATGTTAGGCATTACCTGGGG | 2029. | 5 | | ACCAGTGCTGTGTGACCTTGGA | 2030. | TCCTATGGGAGGGGAGGCTTCT | 2031. | DMSO | 3 | 1 | 1 |
| OT5-34 | CATTTCTTAGTCATTTCCTGAGG | 2032. | 5 | | CCAGTGTGGTGGTTCATGAC | 2033. | GCATACGGCAGTAGAATGAGCC | 2039. | 68C, 3% DMSO | 9 | 0 | 1 |
| OT5-35 | TGCAGCTAACTCATTACCTGGGG | 2035. | 5 | | CAGGCGCTGGGTTCTTAGCCT | 2036. | CCTTCCTGGCCCCCATGGTG | 2037. | DMSO | 2 | 3 | 0 |
| OT5-36 | TTGCTTTTAGTTATTACCTGGGG | 2038. | 5 | | TGGGGTCCAAGATGTCCCT | 2039. | TGAAACTGCTTGATGAGGTGTGGA | 2040. | DMSO | 1 | 2 | 2 |

TABLE E-continued

| Publication ID | Expected Off-Target Sequences (Expected) - HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT5-37 | AACTTGAAAGTC ATTACCTGTGG | 2041. | 6 | | GCTGGGCTTGGTG GTATATGC | 2042. | ACTTGCAA AGCTGATA ACTGACTG A | 2043. | DMSO | 5 | 0 | 1 |
| OT5-38 | AAGGTCACAGTC ATTACCTGGGG | 2044. | 6 | | AGTTGGTGTCACT GACAATGGGA | 2045. | CGCAGCGC ACGAGTTC ATCA | 2046. | DMSO | 3 | 0 | 3 |
| OT5-39 | AATGTCTTCATC ATTACCTGAGG | 2047. | 6 | | AGAGAGGAGGCACAA TTCAACCCCT | 2048. | GGCTGGGG AGGCCTCA CAAT | 2049. | DMSO | 1 | 1 | 4 |
| OT5-40 | AGATGCTTGGTC ATTACCTGTGG | 2050. | 6 | | GGGAAAGTTTGGG AAAGTCAGCA | 2051. | AGGACAAG CTACCCCA CACC | 2052. | DMSO | 1 | 3 | 2 |
| OT5-41 | AGTAGATTAGTT ATTACCTGGGG | 2053. | 6 | | TGGTGCATCAAAG GGTTGCTTCT | 2054. | TCATTCCA GCACGCCG GGAG | 2055. | DMSO | 0 | 3 | 3 |
| OT5-42 | AGTAGGTTAGTA ATTACCTGGGG | 2056. | 6 | | CCCAGGCTTGCCCA TCACACT | 2057. | TGGAGTAA GTATACCT TGGGGACC T | 2058. | DMSO | 1 | 3 | 2 |
| OT5-43 | CAAATGAGAGTC ATTACCTGAGG | 2059. | 6 | | TCAGTGCCCCTGG GTCCTCA | 2060. | TGTGCAAA TACCTAGC ACGGTGC | 2061. | DMSO | 9 | 2 | 0 |
| OT5-44 | CATGTCTTGAATC ATTACCTGAGG | 2062. | 6 | | AGCACTCCCTTTT GAATTTTGGTGCT | 2063. | ACTGAAGT CCAGCCTC TTCCATTT CA | 2069. | DMSO | 2 | 1 | 3 |
| OT5-45 | CCTGACTTGGTC ATTACCTGTGG | 2065. | 6 | | GAAACCGGTCCCT GGTGCCA | 2066. | GGGGAGTA GAGGGTAG TGTTGCC | 2067. | DMSO | 2 | 0 | 4 |
| OT5-46 | CGTGCATTAGTC ATTACCTGAGG | 2068. | 6 | | TTGCGGGTCCCTG TGGAGTC | 2069. | AGGTGCCG TGTTGTGC CCAA | 2070. | DMSO | 1 | 2 | 3 |

TABLE E-continued

| Publication ID | Expected Off-Target Sequences (Expected) - HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| Target 6 | GGAATCCCTTCT GCAGCACCTGG | 2071. | 0 | | GCCCTACATCTGC TCTCCCTCCA | 2072. | GGGCCGGG AAAGAGTT GCTG | 2073. | DMSO | | | |
| OT6-1 | GGAACCCCGTCT GCAGCACCAGG | 2074. | 2 | | TTGGAGTGTGGCC CGGGTTG | 2075. | ACCTCTCT TTCTCTGC CTCACTGT | 2076. | DMSO | 0 | 1 | 1 |
| OT6-2 | GGAACACCTTCT GCAGCTCCAGG | 2077. | 3 | | CACACCATGCTGA TCCAGGC | 2078. | GCAGTACG GAAGCACG AAGC | 2079. | DMSO | 1 | 1 | 1 |
| OT6-3 | GGAAGCTCTGCT GCAGCACCTGG | 2080. | 3 | | CTCCAGGGCTCGC TGTCCAC | 2081. | CTGGGCTC TGCTGGTT CCCC | 2082. | DMSO | 0 | 2 | 1 |
| OT6-4 | GGAATATCTTCT GCAGCCCCAGG | 2083. | 3 | | CTGTGGTAGCCGT GGCCAGG | 2084. | CCCCATAC CACCTCTC CGGGA | 2085. | DMSO | 0 | 2 | 1 |
| OT6-5 | GGAATCACTTTT ACAGCACCAGG | 2086. | 3 | | GGTGCGGGACTT GAATGAG | 2087. | CCAGCGTG TTTCCAAG GGAT | 2088. | 1M betaine, TD | 0 | 1 | 2 |
| OT6-6 | GGAATCCCCTCT CCAGCCCCTGG | 2089. | 3 | GGAATCCCCTCC AGCCCCTGG (SEQ ID NO: 2236) GGAATCCCCCTCC AGCCTCTGG (SEQ ID NO: 2237) | CCAGAGGTGGGGC CCTGTGA | 2090. | TTTCCACA CTCAGTTC TGCAGGA | 2091. | DMSO | 1 | 1 | 1 / 2 |
| OT6-7 | GGAATCTCTTCCTT TCAGCATCTGG | 2092. | 3 | GGAATCTCTTCCTT GGCATCTGG (SEQ ID NO: 2238) | TGTGACTGGTTGT CCTGCTTTCCT | 2093. | GCAGTGTT TTGTGGTG ATGGGCA | 2094. | 1M betaine, TD | 0 | 1 | 5 |
| OT6-8 | GGAATTGCTTCT GCAGCGCCAGG | 2095. | 3 | | CTGGCCAAGGGGT GAGTGGG | 2096. | TGGGACCCC CAGCAGCC AATG | 2097. | DMSO | 1 | 0 | 2 |
| OT6-9 | GGACTCCCCTCT GCAGCAGCTGG | 2098. | 3 | | ACGGTGTGCTGGC TGCTCTT | 2099. | ACAGTGCT GACCGTGC TGGG | 2100. | DMSO | 1 | 1 | 1 |

TABLE E-continued

| Publication ID | Expected Off-Target Sequences (Expected) - HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT6-10 | GGAGTCCCTCCT ACAGCACCAGG | 2101. | 3 | | TGGTTTGGGCCTC AGGGATGG | 2102. | TGCCTCCC ACAAAAT GTCTACCT | 2103. | DMSO | 0 | 0 | 3 |
| OT6-11 | GGAGTCCCTCCT ACAGCACCAGG | 2104. | 3 | | TGGTTTGGGCCTC AGGGATGG | 2105. | ACCCTTA TCCCAGAA CCCATGA | 2106. | DMSO | 0 | 0 | 3 |
| OT6-12 | GGCATCCATTCT GCAGCCCTGG | 2107. | 3 | | TCCAAGTCAGCGA TGAGGGCT | 2108. | TGGGAGCT GTTCTTT TTGGCCA | 2109. | DMSO | 0 | 3 | 0 |
| OT6-13 | GGCTTCCCTTCT GCAGCCCCAGG | 2110. | 3 | | CACCCCTCTCAGC TTCCCAA | 2111. | GCTAGAGG GTCTGCTG CCTT | 2112. | DMSO | 1 | 2 | 0 |
| OT6-14 | TGAATCCCATCT CCAGCACCAGG | 2113. | 3 | | AGACCCCTTGGCC AAGCACA | 2114. | CTTGCTCT CACCCCGC CTCC | 2115. | DMSO | 2 | 1 | 0 |
| OT6-15 | AAAATACTTCT GCAGTACCAGG | 2116. | 4 | | ACATGTGGGAGGC GGACAGA | 2117. | TCTCACTT TGCTGTTA CCGATGTC G | 2118. | DMSO | 0 | 1 | 3 |
| OT6-16 | AAAATCCCTTCT TCAACACCTGG | 2119. | 4 | | GGACGACTGTGCC TGGGACA | 2120. | AGTGCCCA GAGTGTTG TAACTGCT | 2121. | 72C Anneal, 3% DMSO | 0 | 1 | 3 |
| OT6-17 | ACACTCCCTCCT GCAGCACCTGG | 2122. | 4 | | GGAGAGCTCAGCG CCAGTC | 2123. | CAGCGTGG CCCGTGGG AATA | 2124. | DMSO | 1 | 1 | 2 |
| OT6-18 | ACCATCCCTCCT GCAGCACCAGG | 2125. | 4 | | GCTGAAGTGCTCT GGGGTGCT | 2126. | ACCCCACT GTGGATGA ATTGGTAC C | 2127. | DMSO | 1 | 1 | 2 |
| OT6-19 | AGAGGCCCCTCT GCAGCACCAGG | 2128. | 4 | | TCGGGGTGCACAT GGCCATC | 2129. | TTGCCTCG CAGGGGAA GCAG | 2130. | DMSO | 0 | 1 | 3 |

TABLE E-continued

| Publication ID | Expected Off-Target Sequences (Expected) - HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT6-20 | AGGATCCCTTGTGCAGCTCCTGG | 2131. | 4 | | CTCGTGGGAGGCCAAACCT | 2132. | AGCCACCAACACATACCAGGCT | 2133. | DMSO | 2 | 0 | 2 |
| OT6-21 | CCACTCCTTCTGCAGCACCAGG | 2134. | 4 | | GCATGCCTTTAATCCCGGCT | 2135. | AGGATTTCAGAGTGATGGGGCT | 2136. | DMSO | 2 | 1 | 1 |
| OT6-22 | GAAGGCCCTTCAGCAGCACCTGG | 2137. | 4 | | CGCCCAGCCACACAAAGTGCAT | 2138. | GCAAATTTCTGCACCTACTCTAGGCCT | 2139. | DMSO | 1 | 1 | 2 |
| OT6-23 | GATATCCCTTCTGTATCACCTGG | 2140. | 4 | | AGCTCACAAGAATTGGAGGTAACAGT | 2141. | GCAGTCACCCTTCACTGCCTGT | 2142. | DMSO | 1 | 1 | 2 |
| OT6-24 | GGGTCCGCCTTCTGCAGCACCTGG | 2143. | 4 | | AAACTGGGCTGGGCTTCCGG | 2144. | GGGGCTAAGGCATTGTCAGACCC | 2145. | DMSO | 2 | 0 | 2 |
| OT6-25 | GTCTCCCCTTCTGCAGCACCAGG | 2146. | 4 | | GCAGGTAGGCAGTCTGGGGC | 2147. | TCTCCTGCCTCAGCCTCCCA | 2148. | 1M betaine, TD | 1 | 2 | 1 |
| OT6-26 | GTCTCCCCTTCTGCAGCACCAGG | 2149. | 4 | | GCAGGTAGGCAGTCTGGGGC | 2150. | TCTCCTGCCTCAGCCTCCCA | 2151. | 1M betaine, TD | 1 | 2 | 1 |
| OT6-27 | GTCTCCCCTTCTGCAGCACCAGG | 2152. | 4 | | GCAGGTAGGCAGTCTGGGGC | 2153. | TCTCCTGCCTCAGCCTCCCA | 2154. | 1M betaine, TD | 1 | 2 | 1 |
| OT6-28 | TCATTCCCGTCTGCAGCACCCGG | 2155. | 4 | | GCTCTGGGGTAGAAGGAGGC | 2156. | GGCCTGTCAACCAACCAACC | 2157. | DMSO | 2 | 2 | 0 |
| OT6-29 | TGCACCCCTCCTGCAGCACCAGG | 2158. | 4 | | TGACATGTTGTGTGCTGGGC | 2159. | AAATCCTGCAGCCTCCCCTT | 2160. | DMSO | 0 | 2 | 2 |
| OT6-30 | TGCATACCCTCTGCAGCACCAGG | 2161. | 4 | | TCCTGGTGAGATCGTCCACAGGA | 2162. | TCCTCCCCACTCAGCCTCCC | 2163. | DMSO | 0 | 3 | 1 |

TABLE E-continued

| Publication ID | Expected Off-Target Sequences (Expected) - HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT6-31 | TGCATGGCTTCT GCAGCACCAGG | 2164. | 4 | | TCCTAATCCAAGT CCTTTGTTCAGAC A | 2165. | AGGGACCA GCCACTAC CCTTCA | 2166. | DMSO | 2 | 2 | 0 |
| OT6-32 | AATATTCCCTCT GCAGCACCAGG | 2167. | 5 | | GGGACACCAGTTC CTTCCAT | 2168. | GGGGGAGA TTGGAGTT CCCC | 2169. | DMSO | 1 | 0 | 4 |
| OT6-33 | ACCATTTCTTCT GCAGCACCTGG | 2170. | 5 | | ACACCACTATCAA GGCAGAGTAGGT | 2171. | TCTGCCTG GGGTGCTT TCCC | 2172. | DMSO | 1 | 1 | 3 |
| OT6-34 | AGCTCCCATTCT GCAGCACCCGG | 2173. | 5 | | CTGGGAGCGGAGG GAAGTGC | 2174. | GCCCCGAC AGATGAGG CCTC | 2175. | DMSO | 1 | 2 | 2 |
| OT6-35 | CAGATTCCTGCT GCAGCACCGGG | 2176. | 5 | CAGATTACTGCTG AGCACCGGG (SEQ ID NO: 2239) | CGGGTCTCGGAAT GCCTCCA | 2177. | ACCCAGGA ATTGCCAC CCCC | 2178. | DMSO | 1 | 2 | 3 |
| OT6-36 | CCAAGAGCTTCT GCAGCACCTGG | 2179. | 5 | | TTGCTGTGGTCCC GGTGGTG | 2180. | GCAGACAC TAGAGCCC GCCC | 2181. | DMSO | 3 | 2 | 0 |
| OT6-37 | CCCAGCCCTGCT GCAGCACCCGG | 2182. | 5 | | GGTGTGGTGACAG GTCGGGT | 2183. | ACCTGCGT CTCTGTGC TGCA | 2184. | DMSO | 2 | 3 | 0 |
| OT6-38 | CCCCTCCCTCCT GCAGCACCGGG | 2185. | 5 | | CTCCCAGGACAGT GCTGGGC | 2186. | CCTGGCCC CATGCTGC CTG | 2187. | DMSO | 2 | 2 | 1 |
| OT6-39 | CTACTGACTTCT GCAGCACCTGG | 2188. | 5 | | TGCGTAGGTTTTG CCTCTGTGA | 2189. | AGGGAATG ATGTTTTC CACCCCT | 2190. | DMSO | 2 | 3 | 0 |
| OT6-40 | CTCCTCCCTCCT GCAGCACCTGG | 2191. | 5 | | CTCCGAGCCACC GTTGGTA | 2192. | TGCATTGA CGTACGAT GGCTCA | 2193. | DMSO | 1 | 3 | 1 |
| OT6-41 | TCTGTCCCTCCT GCAGCACCTGG | 2194. | 5 | | ACCTGCAGCATGA ACTCTCGCA | 2195. | ACCTGAGC AACATGAC TCACCTGG | 2196. | DMSO | 2 | 1 | 2 |

TABLE E-continued

| Publication ID | Expected Off-Target Sequences - HS GRCh37 | SEQ ID NO: | Mismatches in target compared to on-target site | Actual Target in U2OS.EGFP cells | Forward PCR Primer | SEQ ID NO: | Reverse PCR Primer | SEQ ID NO: | PCR Conditions | Watson-Crick Transversions | non-Watson-Crick Transversions | Transitions |
|---|---|---|---|---|---|---|---|---|---|---|---|---|
| OT6-42 | ACACAAAACTTCT GCAGCACCTGG | 2197. | 6 | ACACAAAACTTCTGC AGCACCTGG ACACAAAACTTCTGC AGCACGTGG (SEQ ID NO: 2240) | TCTCCAGTTCTT GCTCTCATGG | 2198. | ACCATTGG TGAACCCA GTCA | 2199. | 1M betaine, TD | 3 / 2 | 3 | 1 |
| OT6-43 | ACTGTCATTTCT GCAGCACCTGG | 2200. | 6 | | TGGGGTGGTGGTC TTGAATCCA | 2202. | TCAGCTAT AACCTGGG ACTTGTGC T | 2202. | DMSO | 2 | 1 | 3 |
| OT6-44 | ACTTTATCTTCT GCAGCACCTGG | 2203. | 6 | | AGCAGCCAGTCCA GTGTCCTG | 2204. | CCCTTTCA TCGAGAAC CCCAGGG | 2205. | DMSO | 3 | 1 | 2 |
| OT6-45 | ATCCTTTCTTCT GCAGCACCTGG | 2206. | 6 | | TGGACGCTGCTGG GAGGAGA | 2207. | GAGGTCTC GGGCTGCT CGTG | 2208. | DMSO | 0 | 3 | 3 |
| OT6-46 | CACCACCGTTCT GCAGCACCAGG | 2209. | 6 | | AGGTTTGCACTCT GTTGCCTGG | 2210. | TGGGGTGA TTGGTTGC CAGGT | 2211. | DMSO | 3 | 2 | 1 |
| OT6-47 | CATGTGGCTTCT GCAGCACCTGG | 2212. | 6 | | TCTTCCTTTGCCA GGCAGCACA | 2213. | TGCAGGAA TAGCAGT ATGAGGAG T | 2214. | DMSO | 4 | 0 | 2 |
| OT6-48 | CATTTTCTTTCT GCAGCACCTGG | 2215. | 6 | | GGACGCCCTACTGC CTGGACC | 2216. | GCCCTCGC AGCCCATG GTAC | 2217. | DMSO | 3 | 0 | 3 |
| OT6-49 | CTCTGTCCCTTCT GCAGCACCTGG | 2218. | 6 | | AGGCAGTCATCGC GTTGGTA | 2219. | GGTCCCAC CTTCCCCT ACAA | 2220. | DMSO | 2 | 3 | 1 |
| OT6-50 | CTGTACCCTCCT GCAGCACCAGG | 2221. | 6 | | Not optimized | | | | | 3 | 1 | 2 |
| OT6-51 | TTGAGGCCGTCT GCAGCACCTGG | 2222. | 6 | | CCCCAGCCCCCAC CAGTTTC | 2223. | CAGCCCAG GCCACAGC TTCA | 2224. | DMSO | 1 | 4 | 1 |

Sanger Sequencing for Quantifying Frequencies of Indel Mutations

Purified PCR products used for T7EI assay were ligated into a Zero Blunt TOPO vector (Life Technologies) and transformed into chemically competent Top 10 bacterial cells. Plasmid DNAs were isolated and sequenced by the Massachusetts General Hospital (MGH) DNA Automation Core, using an M13 forward primer (5'-GTAAAACGACG-GCCAG-3') (SEQ ID NO:1059).

Restriction Digest Assay for Quantifying Specific Alterations Induced by HDR with ssODNs PCR reactions of specific on-target sites were performed using Phusion high-fidelity DNA polymerase (New England Biolabs). The VEGF and EMX1 loci were amplified using a touchdown PCR program ((98° C., 10 s; 72-62° C., −1° C./cycle, 15 s; 72° C., 30 s)×10 cycles, (98° C., 10 s; 62° C., 15 s; 72° C., 30 s)×25 cycles), with 3% DMSO. The primers used for these PCR reactions are listed in Table E. PCR products were purified by Ampure XP beads (Agencourt) according to the manufacturer's instructions. For detection of the BamHI restriction site encoded by the ssODN donor template, 200 ng of purified PCR products were digested with BamHI at 37° C. for 45 minutes. The digested products were purified by Ampure XP beads (Agencourt), eluted in 20 ul 0.1×EB buffer and analyzed and quantified using a QIAXCEL capillary electrophoresis system.

TruSeq Library Generation and Sequencing Data Analysis

Locus-specific primers were designed to flank on-target and potential and verified off-target sites to produce PCR products ~300 bp to 400 bps in length. Genomic DNAs from the pooled duplicate samples described above were used as templates for PCR. All PCR products were purified by Ampure XP beads (Agencourt) per the manufacturer's instructions. Purified PCR products were quantified on a QIAXCEL capillary electrophoresis system. PCR products for each locus were amplified from each of the pooled duplicate samples (described above), purified, quantified, and then pooled together in equal quantities for deep sequencing. Pooled amplicons were ligated with dual-indexed Illumina TruSeq adaptors as previously described (Fisher et al., 2011). The libraries were purified and run on a QIAXCEL capillary electrophoresis system to verify change in size following adaptor ligation. The adapter-ligated libraries were quantified by qPCR and then sequenced using Illumina MiSeq 250 bp paired-end reads performed by the Dana-Farber Cancer Institute Molecular Biology Core Facilities. We analyzed between 75,000 and 1,270,000 (average ~422,000) reads for each sample. The TruSeq reads were analyzed for rates of indel mutagenesis as previously described (Sander et al., 2013). Specificity ratios were calculated as the ratio of observed mutagenesis at an on-target locus to that of a particular off-target locus as determined by deep sequencing. Fold-improvements in specificity with tru-RGNs for individual off-target sites were calculated as the specificity ratio observed with tru-gRNAs to the specificity ratio for that same target with the matched full-length gRNA. As mentioned in the text, for some of the off-target sites, no indel mutations were detected with tru-gRNAs. In these cases, we used a Poisson calculator to determine with a 95% confidence that the upper limit of the actual number of mutated sequences would be three in number. We then used this upper bound to estimate the minimum fold-improvement in specificity for these off-target sites.

Example 2a. Truncated gRNAs can Efficiently Direct Cas9-Mediated Genome Editing in Human Cells To test the hypothesis that gRNAs truncated at their 5' end might function as efficiently as their full-length counterparts, a series of progressively shorter gRNAs were initially constructed as described above for a single target site in the EGFP reporter gene, with the following sequence: 5'-GGC GAGGGCGATGCCACCTAcGG-3' (SEQ ID NO:2241). This particular EGFP site was chosen because it was possible to make gRNAs to it with 15, 17, 19, and 20 nts of complementarity that each have a G at their 5' end (required for efficient expression from the U6 promoter used in these experiments). Using a human cell-based reporter assay in which the frequency of RGN-induced indels could be quantified by assessing disruption of a single integrated and constitutively expressed enhanced green fluorescent protein (EGFP) gene (Example 1 and Fu et al., 2013; Reyon et al., 2012) (FIG. 2B), the abilities of these variable-length gRNAs to direct Cas9-induced indels at the target site were measured.

As noted above, gRNAs bearing longer lengths of complementarity (21, 23, and 25 nts) exhibit decreased activities relative to the standard full-length gRNA containing 20 nts of complementary sequence (FIG. 2H), a result that matches those recently reported by others (Ran et al., Cell 2013). However, gRNAs bearing 17 or 19 nts of target complementarity showed activities comparable to or higher than the full-length gRNA, while a shorter gRNA bearing only 15 nts of complementary failed to show significant activity (FIG. 2H).

To test the generality of these initial findings, full-length gRNAs and matched gRNAs bearing 18, 17 and/or 16 nts of complementarity to four additional EGFP reporter gene sites (EGFP sites #1, #2, #3, and #4; FIG. 3A) were assayed. At all four target sites, gRNAs bearing 17 and/or 18 nts of complementarity functioned as efficiently as (or, in one case, more efficiently than) their matched full-length gRNAs to induce Cas9-mediated disruption of EGFP expression (FIG. 3A). However, gRNAs with only 16 nts of complementarity showed significantly decreased or undetectable activities on the two sites for which they could be made (FIG. 3A). For each of the different sites tested, we transfected the same amounts of the full-length or shortened gRNA expression plasmid and Cas9 expression plasmid. Control experiments in which we varied the amounts of Cas9 and truncated gRNA expression plasmids transfected for EGFP sites #1, #2, and #3 suggested that shortened gRNAs function equivalently to their full-length counterparts (FIGS. 3E (bottom) and 3F (bottom)) and that therefore we could use the same amounts of plasmids when making comparisons at any given target site. Taken together, these results provide evidence that shortened gRNAs bearing 17 or 18 nts of complementarity can generally function as efficiently as full-length gRNAs and hereafter the truncated gRNAs with these complementarity lengths are referred to as "tru-gRNAs" and RGNs using these tru-gRNAs as "tru-RGNs".

Whether tru-RGNs could efficiently induce indels on chromatinized endogenous gene targets was tested next. Tru-gRNAs were constructed for seven sites in three endogenous human genes (VEGFA, EMX1, and CLTA), including four sites that had previously been targeted with standard full-length gRNAs in three endogenous human genes: VEGFA site 1, VEGFA site 3, EMX1 and CTLA (Example 1 and Fu et al., 2013; Hsu et al., 2013; Pattanayak et al., 2013) (FIG. 3B). (It was not possible to test a tru-gRNA for VEGFA site 2 from Example 1, because this target sequence does not have the G at either position 17 or 18 of the complementarity region required for gRNA expression from a U6 promoter.) Using a well-established T7 Endonuclease I (T7EI) genotyping assay (Reyon et al., 2012) as described above, the Cas9-mediated indel mutation frequencies induced by each of these various gRNAs at their respective target sites was quantified in human U2OS.EGFP cells. For all five of the seven four sites, tru-RGNs robustly induced indel mutations with efficiencies comparable to those mediated by matched standard RGNs (FIG. 3B). For the two sites on which tru-RGNs showed lower activities than their full-length counterparts, we note that the absolute rates of mutagenesis were still high (means of 13.3% and 16.6%) at levels that would be useful for most applications. Sanger sequencing for three of these target sites (VEGFA sites 1 and 3 and EMX1) confirmed that indels induced by tru-RGNs originate at the expected site of cleavage and that these mutations are essentially indistinguishable from those induced with standard RGNs (FIG. 3C and FIGS. 7A-D).

We also found that tru-gRNAs bearing a mismatched 5' G and an 18 nt complementarity region could efficiently direct Cas9-induced indels whereas those bearing a mismatched 5' G and a 17 nt complementarity region showed lower or undetectable activities compared with matched full-length gRNAs (FIG. 7E), consistent with our findings that a minimum of 17 nts of complementarity is required for efficient RGN activity.

To further assess the genome-editing capabilities of tru-RGNs, their abilities to induce precise sequence alterations via HDR with ssODN donor templates were tested. Previous studies have shown that Cas9-induced breaks can stimulate the introduction of sequence from a homologous ssODN donor into an endogenous locus in human cells (Cong et al., 2013; Mali et al., 2013c; Ran et al., 2013; Yang et al., 2013). Therefore, the abilities were compared of matched full-length and tru-gRNAs targeted to VEGFA site 1 and to the EMX1 site to introduce a BamHI restriction site encoded on homologous ssODNs into these endogenous genes. At both sites, tru-RGNs mediated introduction of the BamHI site with efficiencies comparable to those seen with standard RGNs harboring their full-length gRNA counterparts (FIG. 3D). Taken together, this data demonstrate that tru-RGNs can function as efficiently as standard RGNs to direct both indels and precise HDR-mediated genome editing events in human cells.

Example 2b. Tru-RGNs Exhibit Enhanced Sensitivities to gRNA/DNA Interface Mismatches Having established that tru-RGNs can function efficiently to induce on-target genome editing alterations, whether these nucleases would show greater sensitivity to mismatches at the gRNA/DNA interface was tested. To assess this, a systematic series of variants was constructed for the tru-gRNAs that were previously tested on EGFP sites #1, #2, and #3 (FIG. 3A above). The variant gRNAs harbor single Watson-Crick substitutions at each position within the complementarity region (with the exception of the 5' G required for expression from the U6 promoter) (FIG. 5A). The human cell-based EGFP disruption assay was used to assess the relative abilities of these variant tru-gRNAs and an analogous set of matched variant full-length gRNAs made to the same three sites as described in Example 1 to direct Cas9-mediated indels. The results show that for all three EGFP target sites, tru-gRNAs generally showed greater sensitivities to single mismatches than standard RGNs harboring matched full-length gRNAs (compare bottom and top panels of FIG. 5A). The magnitude of sensitivity varied by site, with the greatest differences observed for sites #2 and #3, whose tru-gRNAs harbored 17 nts of complementarity.

Encouraged by the increased sensitivity of tru-RGNs to single nucleotide mismatches, we next sought to examine the effects of systematically mismatching two adjacent positions at the gRNA-DNA interface. We therefore made variants of the tru-gRNAs targeted to EGFP target sites #1, #2, and #3, each bearing Watson-Crick transversion substitutions at two adjacent nucleotide positions (FIG. 5B). As judged by the EGFP disruption assay, the effects of adjacent double mismatches on RGN activity were again substantially greater for tru-gRNAs than for the analogous variants made in Example 1 for matched full-length gRNAs targeted to all three EGFP target sites (compare bottom to top panels in FIG. 5B). These effects appeared to be site-dependent with nearly all of the double-mismatched tru-gRNAs for EGFP sites #2 and #3 failing to show an increase in EGFP disruption activities relative to a control gRNA lacking a complementarity region and with only three of the mismatched tru-gRNA variants for EGFP site #1 showing any residual activities (FIG. 5B). In addition, although double mutations generally showed greater effects on the 5' end with full-length gRNAs, this effect was not observed with tru-gRNAs. Taken together, our data suggest that tru-gRNAs exhibit greater sensitivities than full-length gRNAs to single and double Watson-Crick transversion mismatches at the gRNA-DNA interface.

Example 2c. Tru-RGNs Targeted to Endogenous Genes Show Improved Specificities in Human Cells The next experiments were performed to determine whether tru-RGNs might show reduced genomic off-target effects in human cells relative to standard RGNs harboring full-length gRNA counterparts. We examined matched full-length and tru-gRNAs targeted to VEGFA site 1, VEGFA site 3, and EMX1 site 1 (described in FIG. 3B above) because previous studies (see Example 1 and Fu et al., 2013; Hsu et al., 2013) had defined 13 bona fide off-target sites for the full-length gRNAs targeted to these sites. (We were unable to test a tru-gRNA for VEGFA site 2 from our original study6 because this target sequence does not have the G at either position 17 or 18 of the complementarity region required for efficient gRNA expression from a U6 promoter.) Strikingly, we found that tru-RGNs showed substantially reduced mutagenesis activity in human U2OS.EGFP cells relative to matched standard RGNs at all 13 of these bona fide off-target sites as judged by T7EI assay (Table 3A); for 11 of the 13 off-target sites, the mutation frequency with tru-RGNs dropped below the reliable detection limit of the T7EI assay (2-5%) (Table 3A). We observed similar results when these matched pairs of standard and tru-RGNs were tested at the same 13 off-target sites in another human cell line (FT-HEK293 cells) (Table 3A).

To quantify the magnitude of specificity improvement observed with tru-RGNs, we measured off-target mutation frequencies using high-throughput sequencing, which provides a more sensitive method for detecting and quantifying low frequency mutations than the T7EI assay. We assessed a subset of 12 of the 13 bona fide off-target sites for which we had seen decreased mutation rates with tru-gRNAs by T7EI assay (for technical reasons, we were unable to amplify the required shorter amplicon for one of the sites) and also examined an additional off-target site for EMX1 site 1 that had been identified by another group7 (FIG. 6A).

For all 13 off-target sites we tested, tru-RGNs showed substantially decreased absolute frequencies of mutagenesis relative to matched standard RGNs (FIG. 6A and Table 3B) and yielded improvements in specificity of as much as ~5000-fold or more relative to their standard RGN counterparts (FIG. 6B). For two off-target sites (OT1-4 and OT1-11), it was difficult to quantify the on-target to off-target ratios for tru-RGNs because the absolute number and frequency of indel mutations induced by tru-RGNs fell to background or near-background levels. Thus, the ratio of on-target to off-target rates would calculate to be infinite in these cases. To address this, we instead identified the maximum likely indel frequency with a 95% confidence level for these sites and then used this conservative estimate to calculate the minimum likely magnitude of specificity improvement for tru-RGNs relative to standard RGNs for these off-targets. These calculations suggest tru-RGNs yield improvements of ~10,000-fold or more at these sites (FIG. 6B).

To further explore the specificity of tru-RGNs, we examined their abilities to induce off-target mutations at additional closely related sites in the human genome. For the tru-gRNAs to VEGFA site 1 and EMX1, which each possess 18 nts of target site complementarity, we computationally identified all additional sites in the human genome mismatched at one or two positions within the complementarity region (not already examined above in Table 3A) and a subset of all sites mismatched at three positions among which we favored mismatches in the 5' end of the site as described in Example 1. For the tru-gRNA to VEGFA site 3, which possesses 17 nts of target site complementarity, we identified all sites mismatched at one position and a subset of all sites mismatched at two positions among which mismatches in the 5' end were favored (again not already examined in Table 3A). This computational analysis yielded a total of 30, 30, and 34 additional potential off-target sites for the tru-RGNs targeted to VEGFA site 1, VEFGA site 3, and the EMX1 site, respectively, which we then assessed for mutations using T7EI assay in human U2OS.EGFP and HEK293 cells in which the RGNs had been expressed.

Strikingly, the three tru-RGNs to VEGFA site 1, VEFGA site 3, and EMX1 did not induce detectable Cas9-mediated indel mutations at 93 of the 94 potential off-target sites examined in human U2OS.EGFP cells or at any of the 94 potential off-target sites in human HEK293 cells (Table 3C). For the one site at which off-target mutations were seen, whether the standard RGN with a full-length gRNA targeted to VEGFA site 1 could also mutagenize this same off-target site was examined; it induced detectable mutations albeit at a slightly lower frequency (FIG. 6C). The lack of improvement observed with shortening of the gRNA at this off-target site can be understood by comparing the 20 and 18 nt sequences for the full-length and tru-gRNAs, which shows that the two additional bases in the full-length 20 nt target are both mismatched (FIG. 6C). In summary, based on this survey of 94 additional potential off-target sites, shortening of the gRNA does not appear to induce new high-frequency off-target mutations.

Deep sequencing of a subset of the 30 most closely matched potential off-target sites from this set of 94 site (i.e.—those with one or two mismatches) showed either undetectable or very low rates of indel mutations (Table 3D) comparable to what we observed at other previously identified off-target sites (Table 3B). We conclude that tru-RGNs generally appear to induce either very low or undetectable levels of mutations at sites that differ by one or two mismatches from the on-target site. This contrasts with standard RGNs for which it was relatively easy to find high-frequency off-target mutations at sites that differed by as many as five mismatches (see Example 1).

TABLE 3A

On- and off-target mutation frequencies of matched tru-RGNs and standard RGNs targeted to endogenous genes in human U2OS.EGFP and HEK 293 cells

| Target ID | 20 mer Target | SEQ ID NO: | Indel mutation frequency (%) ± s.e.m. U2OS.EGFP | HEK293 | Truncated Target | SEQ ID NO: | Indel mutation frequency (%) ± s.e.m. U2OS.EGFP | HEK293 | Gene |
|---|---|---|---|---|---|---|---|---|---|
| T1 | GGGTGGGGGGAGTTTGCTCCtGG | 2242 | 23.69 ± 1.99 | 6.96 ± 1.33 | GTGGGGGGAGTTTGCTCCtGG | 2243 | 23.93 ± 4.37 | 8.34 ± 0.01 | VEGFA |
| OT1-3 | GGATGGAGGGAGTTTGCTCCtGG | 2244 | 17.25 ± 2.97 | 7.26 ± 0.62 | ATGGAGGGAGTTTGCTCCtGG | 2245 | N.D. | N.D. | IGDCC3 |
| OT1-4 | GGGAGGGTGGAGTTTGCTCCtGG | 2246 | 6.23 ± 0.20 | 2.66 ± 0.30 | GAGGGTGGAGTTTGCTCCtGG | 2247 | N.D. | N.D. | LOC116437 |
| OT1-6 | CGGGGAGGGAGTTTGCTCCtGG | 2248 | 3.73 ± 0.23 | 1.41 ± 0.07 | GGGGAGGGAGTTTGCTCCtGG | 2249 | N.D. | N.D. | CACNA2D |
| OT1-11 | GGGGAGGGAAGTTTGCTCCtGG | 2250 | 10.4 ± 0.7 | 3.61 ± 0.02 | GGAGGGGAAGTTTGCTCCtGG | 2251 | N.D. | N.D. | |
| T3 | GGTGAGTGAGTGTGTGCGTGtGG | 2252 | 54.08 ± 1.02 | 22.97 ± 0.17 | GAGTGAGTGTGTGCGTGtGG | 2253 | 50.49 ± 1.25 | 20.05 ± 0.01 | VEGFA |
| OT3-1 | GGTGAGTGAGTGTGTGTGTGaGG | 2254 | 6.16 ± 0.98 | 6.02 ± 0.11 | GAGTGAGTGTGTGTGTGaGG | 2255 | N.D. | N.D. | (abParts) |
| OT3-2 | AGTGAGTGAGTGTGTGTGTGgGG | 2256 | 19.64 ± 1.06 | 11.29 ± 0.27 | GAGTGAGTGTGTGTGTGgGG | 2257 | 5.52 ± 0.25 | 3.41 ± 0.07 | MAX |

TABLE 3A-continued

On- and off-target mutation frequencies of matched tru-RGNs and standard RGNs targeted to endogenous genes in human U2OS.EGFP and HEK 293 cells

| Target ID | 20 mer Target | SEQ ID NO: | Indel mutation frequency (%) ± s.e.m. U2OS.EGFP | HEK293 | Truncated Target | SEQ ID NO: | Indel mutation frequency (%) ± s.e.m. U2OS.EGFP | HEK293 | Gene |
|---|---|---|---|---|---|---|---|---|---|
| OT3-4 | GCTGAGTGAGTGTATGCGTGtGG | 2258 | 7.95 ± 0.11 | 4.50 ± 0.02 | GAGTGAGTGTATGCGTGtGG | 2259 | 1.69 ± 0.26 | 1.27 ± 0.10 | |
| OT3-9 | GGTGAGTGAGTGCGTGCGGGtGG | 2260 | N.D. | 1.09 ± 0.17 | GAGTGAGTGCGTGCGGGtGG | 2261 | N.D. | N.D. | TPCN2 |
| OT3-17 | GTTGAGTGAATGTGTGCGTGaGG | 2262 | 1.85 ± 0.08 | N.D. | GAGTGAATGTGTGCGTGaGG | 2263 | N.D. | N.D. | SLIT1 |
| OT3-18 | TGTGGGTGAGTGTGTGCGTGaGG | 2264 | 6.16 ± 0.56 | 6.27 ± 0.09 | GGGTGAGTGTGTGCGTGaGG | 2265 | N.D. | N.D. | COMDA |
| OT3-20 | AGAGAGTGAGTGTGTGCATGaGG | 2266 | 10.47 ± 1.08 | 4.38 ± 0.58 | GAGTGAGTGTGTGCATGaGG | 2267 | N.D. | N.D. | |
| T4 | GAGTCCGAGCAGAAGAAGAAgGG | 2268 | 41.56 ± 0.20 | 12.65 ± 0.31 | GTCCGAGCAGAAGAAGAAgGG | 2269 | 43.01 ± 0.87 | 17.25 ± 0.64 | EMX1 |
| OT4-2 | GAGTTAGAGCAGAAGAAGAAaGG | 2270 | 19.26 ± 0.73 | 4.14 ± 0.66 | GTTAGAGCAGAAGAAGAAaGG | 2271 | N.D. | N.D. | HCN1 |
| OT-4_Hsu31 | GAGTCTAAGCAGAAGAAGAAgAG | 2272 | 4.37 ± 0.58 | N.D. | GTCTAAGCAGAAGAAGAAgAG | 2273 | N.D. | N.D. | MFAP1 |

Mutation frequencies were measured by T7EI assay. Means of duplicate measurements are shown with error bars representing standard errors of the mean. *Off-target site OT4_53 is the same as EMX1 target 3 OT31 from Hsu et al., 2013.

TABLE 3B

Numbers of wild-type (WT) and indel mutation sequencing reads from deep sequencing experiments

| | Control | | | tru-RGN | | | Standard RGN | | |
|---|---|---|---|---|---|---|---|---|---|
| Site | Indel | WT | Freq. | Indel | WT | Freq. | Indel | WT | Freq. |
| VEGFA site 1 | 45 | 140169 | 0.03% | 122858 | 242127 | 33.66% | 150652 | 410479 | 26.85% |
| OT1-3 | 0 | 132152 | 0.00% | 1595 | 205878 | 0.77% | 50973 | 144895 | 26.02% |
| OT1-4 | 0 | 133508 | 0.00% | 0 | 223881 | 0.00% | 22385 | 240873 | 8.50% |
| OT1-6 | 3 | 213642 | 0.00% | 339 | 393124 | 0.09% | 24332 | 424458 | 5.21% |
| OT1-11 | 1 | 930894 | 0.00% | 0 | 274779 | 0.00% | 43738 | 212212 | 17.09% |
| VEGFA site 3 | 5 | 212571 | 0.00% | 303913 | 292413 | 50.96% | 183626 | 174740 | 51.24% |
| OT3-2 | 1169 | 162545 | 0.71% | 9415 | 277616 | 3.28% | 26545 | 222482 | 10.66% |
| OT3-4 | 7 | 383006 | 0.00% | 15551 | 1135673 | 1.35% | 42699 | 546203 | 7.25% |
| OT3-9 | 73 | 145367 | 0.05% | 113 | 227874 | 0.05% | 1923 | 168293 | 1.13% |
| OT3-17 | 8 | 460498 | 0.00% | 31 | 1271276 | 0.00% | 16760 | 675708 | 2.42% |
| OT3-18 | 7 | 373571 | 0.00% | 284 | 1275982 | 0.02% | 72354 | 599030 | 10.78% |
| OT3-20 | 5 | 140848 | 0.00% | 593 | 325162 | 0.18% | 30486 | 202733 | 13.07% |
| EMX1 site 1 | 1 | 158838 | 0.00% | 49104 | 102805 | 32.32% | 128307 | 307584 | 29.44% |
| OT4-1 | 10 | 169476 | 0.01% | 13 | 234039 | 0.01% | 47426 | 125683 | 27.40% |
| OT4-52 | 2 | 75156 | 0.00% | 10 | 231090 | 0.00% | 429 | 340201 | 0.13% |
| OT4-53 | 0 | 234069 | 0.00% | 6 | 367811 | 0.00% | 17421 | 351667 | 4.72% |

Freq. = frequency of indel mutations = number of indel sequences/number of wild-type sequences. Control gRNA = gRNA lacking a complementarity region

TABLE 3C

Indel mutation frequencies at potential off-target sites of tru-RGNs targeted to endogenous genes in human cells

| Target ID | Target Site + PAM | SEQ ID NO: | Number of mismatches | Indel mutation frequency (%) ± s.e.m. U2OS.EGFP cells | HEK293 cells |
|---|---|---|---|---|---|
| VEGFA Site 1 | GTGGGGGGAGTTTGCTCCtGG | 2274. | 0 (on-target) | 23.93 ± 4.37 | 8.34 ± 0.01 |
|  | GTGGGGGGAGTTTGCCCCaGG | 2275. | 1 | Not detected | Not detected |
|  | GTGGGGGGTGTTTGCTCCcGG | 2276. | 1 | Not detected | Not detected |
|  | GTGGGTGGAGTTTGCTACtGG | 2277. | 2 | Not detected | Not detected |
|  | GTGGGGGGAGCTTTCTCCtGG | 2278. | 2 | Not detected | Not detected |
|  | GTGGGTGGCGTTTGCTCCaGG | 2279. | 2 | Not detected | Not detected |
|  | GTGGAGGGAGCTTGCTCCtGG | 2280. | 2 | 6.88 ± 0.19 | Not detected |
|  | GTGGGTGGAGTTTGCTACaGG | 2281. | 2 | Not detected | Not detected |
|  | GGGGGGGCAGTTTGCTCCtGG | 2282. | 2 | Not detected | Not detected |
|  | GTGTGGGGAATTTGCTCCaGG | 2283. | 2 | Not detected | Not detected |
|  | CTGCTGGGAGTTTGCTCCtGG | 2284. | 3 | Not detected | Not detected |
|  | TTTGGGAGAGTTTGCTCCtGG | 2285. | 3 | Not detected | Not detected |
|  | CTGAGGGCAGTTTGCTCCaGG | 2286. | 3 | Not detected | Not detected |
|  | GTAAGGGAAGTTTGCTCCtGG | 2287. | 3 | Not detected | Not detected |
|  | GGGGGTAGAGTTTGCTCCaGG | 2288. | 3 | Not detected | Not detected |
|  | GGGTGGGGACTTTGCTCCaGG | 2289. | 3 | Not detected | Not detected |
|  | GGGGAGCAGTTTGCTCCaGG | 2290. | 3 | Not detected | Not detected |
|  | TTGGGGTTAGTTTGCTCCtGG | 2291. | 3 | Not detected | Not detected |
|  | TTGAGGGAGTCTGCTCCaGG | 2292. | 3 | Not detected | Not detected |
|  | CTGGGGTGATTTTGCTCCtGG | 2293. | 3 | Not detected | Not detected |
|  | GAGAGGGGAGTTGGCTCCtGG | 2294. | 3 | Not detected | Not detected |
|  | TTTGGGGGAGTTTGCCCCaGG | 2295. | 3 | Not detected | Not detected |
|  | TTCGGGGGAGTTTGCGCCgGG | 2296. | 3 | Not detected | Not detected |
|  | CTCGGGGGAGTTTGCACCaGG | 2297. | 3 | Not detected | Not detected |
|  | GTGTTGGGAGTCTGCTCCaGG | 2298. | 3 | Not detected | Not detected |
|  | GAGGGGGCAGGTTGCTCCaGG | 2299. | 3 | Not detected | Not detected |
|  | GAGGGGAGAGTTTGTTCCaGG | 2300. | 3 | Not detected | Not detected |
|  | GTGGCTGGAGTTTGCTGCtGG | 2301. | 3 | Not detected | Not detected |
|  | GTCGGGGGAGTGGGCTCCaGG | 2302. | 3 | Not detected | Not detected |
|  | GAGGGGGGAGTGTGTTCCgGG | 2303. | 3 | Not detected | Not detected |
|  | GTGGTGGGAGCTTGTTCCtGG | 2304. | 3 | Not detected | Not detected |
|  | GTGGGGGGTGCCTGCTCCaGG | 2305. | 3 | Not detected | Not detected |
| VEGFA Site 3 | GAGTGAGTGTGTGCGTGtGG | 2306. | 0 (on-target) | 50.49 ± 1.25 | 20.05 ± 0.01 |
|  | CAGTGAGTGTGTGCGTGtGG | 2307. | 1 | Not detected | Not detected |
|  | GTGTGAGTGTGTGCGTGgGG | 2308. | 1 | Not detected | Not detected |
|  | GTGTGAGTGTGTGCGTGaGG | 2309. | 1 | Not detected | Not detected |
|  | GTGTGAGTGTGTGCGTGtGG | 2310. | 1 | Not detected | Not detected |
|  | GAGTGTGTGTGTGCGTGtGG | 2311. | 1 | Not detected | Not detected |
|  | GAGTGGGTGTGTGCGTGgGG | 2312. | 1 | Not detected | Not detected |
|  | GAGTGACTGTGTGCGTGtGG | 2313. | 1 | Not detected | Not detected |
|  | GAGTGAGTGTGTGGGTGgGG | 2314. | 1 | Not detected | Not detected |
|  | GAGTGAGTGTGTGTGTGtGG | 2315. | 1 | Not detected | Not detected |
|  | GAGTGAGTGTGTGTGTGtGG | 2316. | 1 | Not detected | Not detected |
|  | GAGTGAGTGTGTGTGTGgGG | 2317. | 1 | Not detected | Not detected |
|  | GAGTGAGTGTGTGTGTGtGG | 2318. | 1 | Not detected | Not detected |
|  | GAGTGAGTGTGTGCGCGgGG | 2319. | 1 | Not detected | Not detected |
|  | CTGTGAGTGTGTGCGTGaGG | 2320. | 2 | Not detected | Not detected |
|  | ATGTGAGTGTGTGCGTGtGG | 2321. | 2 | Not detected | Not detected |
|  | GCCTGAGTGTGTGCGTGtGG | 2322. | 2 | Not detected | Not detected |
|  | GTGTGTGTGTGTGCGTGtGG | 2323. | 2 | Not detected | Not detected |
|  | GTGTGGGTGTGTGCGTGtGG | 2324. | 2 | Not detected | Not detected |
|  | GCGTGTGTGTGTGCGTGtGG | 2325. | 2 | Not detected | Not detected |
|  | GTGTGTGTGTGTGCGTGgGG | 2326. | 2 | Not detected | Not detected |
|  | GTGTGCGTGTGTGCGTGtGG | 2327. | 2 | Not detected | Not detected |
|  | GTGTGTGTGTGTGCGTGcGG | 2328. | 2 | Not detected | Not detected |
|  | GAGAGAGAGTGTGCGTGtGG | 2329. | 2 | Not detected | Not detected |
|  | GAGTGTGTGAGTGCGTGgGG | 2330. | 2 | Not detected | Not detected |
|  | GTGTGAGTGTGTGTGTGtGG | 2331. | 2 | Not detected | Not detected |
|  | GTGTGTGTGTATGCGTGtGG | 2332. | 2 | Not detected | Not detected |
|  | GAGTCAGTGTGTGAGTGaGG | 2333. | 2 | Not detected | Not detected |
|  | GAGTGTGTGTGTGAGTGtGG | 2334. | 2 | Not detected | Not detected |
|  | GAGTGTGTGTGTGCATGtGG | 2335. | 2 | Not detected | Not detected |
|  | GAGTGAGAGTGTGTGTGtGG | 2336. | 2 | Not detected | Not detected |
|  | GAGTGAGTGAGTGAGTGaGG | 2337. | 2 | Not detected | Not detected |
| EMX1 site | GTCCGAGCAGAAGAAGAAgGG | 2338. | 0 (on-target) | 43.01 ± 0.87 | 17.25 ± 0.64 |
|  | GTCTGAGCAGAAGAAGAAtGG | 2339. | 1 | Not detected | Not detected |
|  | GTCCCAGCAGTAGAAGAAtGG | 2340. | 2 | Not detected | Not detected |
|  | GTCCGAGGAGAGGAAGAAaGG | 2341. | 2 | Not detected | Not detected |
|  | GTCAGAGGAGAAGAAGAAgGG | 2342. | 2 | Not detected | Not detected |

TABLE 3C-continued

Indel mutation frequencies at potential off-target sites of tru-RGNs targeted to endogenous genes in human cells

| Sequence | S# | | | |
|---|---|---|---|---|
| GACAGAGCAGAAGAAGAAgGG | 2343. | 2 | Not detected | Not detected |
| GTGGGAGCAGAAGAAGAAgGG | 2344. | 2 | Not detected | Not detected |
| GTACTAGCAGAAGAAGAAaGG | 2345. | 2 | Not detected | Not detected |
| GTCTGAGCACAAGAAGAAtGG | 2346. | 2 | Not detected | Not detected |
| GTGCTAGCAGAAGAAGAAgGG | 2347. | 2 | Not detected | Not detected |
| TACAGAGCAGAAGAAGAAtGG | 2348. | 3 | Not detected | Not detected |
| TACGAGCAGAAGAAGAAtGG | 2349. | 3 | Not detected | Not detected |
| AACGAGCAGAAGAAGAAaGG | 2350. | 3 | Not detected | Not detected |
| GACACAGCAGAAGAAGAAgGG | 2351. | 3 | Not detected | Not detected |
| CTGCGATCAGAAGAAGAAaGG | 2352. | 3 | Not detected | Not detected |
| GACTGGCAGAAGAAGAAgGG | 2353. | 3 | Not detected | Not detected |
| TTCCCTGCAGAAGAAGAAaGG | 2354. | 3 | Not detected | Not detected |
| TTCCTACCAGAAGAAGAAtGG | 2355. | 3 | Not detected | Not detected |
| CTCTGAGGAGAAGAAGAAaGG | 2356. | 3 | Not detected | Not detected |
| ATCCAATCAGAAGAAGAAgGG | 2357. | 3 | Not detected | Not detected |
| GCCCCTGCAGAAGAAGAAcGG | 2358. | 3 | Not detected | Not detected |
| ATCCAACCAGAAGAAGAAaGG | 2359. | 3 | Not detected | Not detected |
| GACTGAGAAGAAGAAGAAaGG | 2360. | 3 | Not detected | Not detected |
| GTGGGATCAGAAGAAGAAaGG | 2361. | 3 | Not detected | Not detected |
| GACAGAGAAGAAGAAGAAaGG | 2362. | 3 | Not detected | Not detected |
| GTCATGGCAGAAGAAGAAaGG | 2363. | 3 | Not detected | Not detected |
| GTTGGAGAAGAAGAAGAAgGG | 2364. | 3 | Not detected | Not detected |
| GTAAGAGAAGAAGAAGAAgGG | 2365. | 3 | Not detected | Not detected |
| CTCCTAGCAAAAGAAGAAtGG | 2366. | 3 | Not detected | Not detected |
| TTCAGAGCAGGAGAAGAAtGG | 2367. | 3 | Not detected | Not detected |
| GTTGGAGCAGGAGAAGAAgGG | 2368. | 3 | Not detected | Not detected |
| GCCTGAGCAGAAGGAGAAgGG | 2369. | 3 | Not detected | Not detected |
| GTCTGAGGACAAGAAGAAtGG | 2370. | 3 | Not detected | Not detected |
| GTCCGGGAAGGAGAAGAAaGG | 2371. | 3 | Not detected | Not detected |
| GGCCGAGCAGAAGAAAGAcGG | 2372. | 3 | Not detected | Not detected |
| GTCCTAGCAGGAGAAGAAgAG | 2373. | 3 | Not detected | Not detected |

TABLE 3D

Frequencies of tru-RGN-induced indel mutations at potential off-target sites in human U2OS.EGFP as determined by deep sequencing

| On-target site | Off-target site sequence | S# | tru-RGN Indel | WT | Freq. | Control Indel | WT | Freq |
|---|---|---|---|---|---|---|---|---|
| VEGFA site 1 | GTGGGGGGAGTTTGCCCCaGG | 2374. | 1500 | 225640 | 0.66% | 3 | 135451 | 0.00% |
| | GTGGGGGTGTTTGCTCCcGG | 2375. | 1552 | 152386 | 1.01% | 0 | 86206 | 0.00% |
| | GTGGGTGGAGTTTGCTACtGG | 2376. | 1 | 471818 | 0.00% | 0 | 199581 | 0.00% |
| | GTGGGTGGAGTTTGCTACaGG | 2377. | 0 | 337298 | 0.00% | 1 | 211547 | 0.00% |
| | GTGGGTGGCGTTTGCTCCaGG | 2378. | 2 | 210174 | 0.00% | 1 | 105531 | 0.00% |
| | GTGTGGGAATTTGCTCCaGG | 2379. | 673 | 715547 | 0.09% | 1 | 387097 | 0.00% |
| | GTGGGGGGAGCTTTCTCCtGG | 2380. | 5 | 107757 | 0.00% | 1 | 58735 | 0.00% |
| | GGGGGGGGCAGTTTGCTCCtGG | 2381. | 1914 | 566548 | 0.34% | 3 | 297083 | 0.00% |
| VEGFA site 3 | GTGTGAGTGTGTGCGTGtGG | 2382. | 58 | 324881 | 0.02% | 9 | 122216 | 0.01% |
| | GTGTGAGTGTGTGCGTGaGG | 2383. | 532 | 194914 | 0.27% | 11 | 73644 | 0.01% |
| | GAGTGGGTGTGTGCGTGgGG | 2384. | 70 | 237029 | 0.03% | 10 | 178258 | 0.01% |
| | GAGTGACTGTGTGCGTGtGG | 2385. | 6 | 391894 | 0.00% | 0 | 239460 | 0.00% |
| | GAGTGAGTGTGTGGGTGgGG | 2386. | 15 | 160140 | 0.01% | 10 | 123324 | 0.01% |
| | GTGTGAGTGTGTGCGTGgGG | 2387. | 19 | 138687 | 0.01% | 1 | 196271 | 0.00% |
| | CAGTGAGTGTGTGCGTGtGG | 2388. | 78 | 546865 | 0.01% | 41 | 355953 | 0.01% |
| | GTGTGAGTGTGTGCGTGtGG | 2389. | 128 | 377451 | 0.03% | 56 | 133978 | 0.04% |
| | GAGTGTGTGTGTGCGTGtGG | 2390. | 913 | 263028 | 0.35% | 78 | 178979 | 0.04% |
| | GAGTGAGTGTGTTGTGtGG | 2391. | 40 | 106933 | 0.04% | 36 | 58812 | 0.06% |
| | GAGTGAGTGTGTTGTGtGG | 2392. | 681 | 762999 | 0.09% | 63 | 222451 | 0.03% |
| | GAGTGAGTGTGTTGTGgGG | 2393. | 331 | 220289 | 0.15% | 100 | 113911 | 0.09% |
| | GAGTGAGTGTGTTGTGtGG | 2394. | 0 | 35725 | 0.00% | 8 | 186495 | 0.00% |
| | GAGTGAGTGTGTGCGGGG | 2395. | 94 | 246893 | 0.04% | 16 | 107623 | 0.01% |
| EMX1 site 1 | GTCAGAGGAGAAGAAGAAgGG | 2396. | 0 | 201483 | 0.00% | 4 | 148416 | 0.00% |
| | GTCAGAGGAGAAGAAGAAgGG | 2397. | 10 | 545662 | 0.00% | 5 | 390884 | 0.00% |
| | GTCTGAGCACAAGAAGAAtGG | 2398. | 2 | 274212 | 0.00% | 0 | 193837 | 0.00% |
| | GTCTGAGCAGAAGAAGAAtGG | 2399. | 440 | 375646 | 0.12% | 10 | 256181 | 0.00% |
| | GACAGAGCAGAAGAAGAAgGG | 2400. | 2 | 212472 | 0.00% | 1 | 158860 | 0.00% |

TABLE 3D-continued

Frequencies of tru-RGN-induced indel mutations at potential off-target sites in human U2OS.EGFP as determined by deep sequencing

| On-target site | Off-target site sequence | S# | tru-RGN Indel | WT | Freq. | Control Indel | WT | Freq |
|---|---|---|---|---|---|---|---|---|
| | GTACTAGCAGAAGAAGAAaGG | 2401. | 152 | 229209 | 0.07% | 103 | 157717 | 0.07% |
| | GTGGGAGCAGAAGAAGAAgGG | 2402. | 50 | 207401 | 0.02% | 36 | 111183 | 0.03% |
| | GTCCCAGCAGT_AGAAGAAtGG | 2403. | 0 | 226477 | 0.00% | 1 | 278948 | 0.00% |

S#: SEQ ID NO:

Example 2d. Tru-gRNAs can be Used with Dual Cas9 Nickases to Efficiently Induce Genome Editing in Human Cells tru-gRNAs were tested with the recently described dual Cas9 nickase approach to induce indel mutations. To do this, the Cas9-D10A nickase together with two full-length gRNAs targeted to sites in the human VEGFA gene (VEGFA site 1 and an additional sequence we refer to as VEGFA site 4) were co-expressed in U2OS.EGFP cells (FIG. 4A). As described previously (Ran et al., 2013), this pair of nickases functioned cooperatively to induce high rates of indel mutations at the VEGFA target locus (FIG. 4B). Interestingly, Cas9-D10A nickase co-expressed with only the gRNA targeted to VEGFA site 4 also induced indel mutations at a high frequency, albeit at a rate somewhat lower than that observed with the paired full-length gRNAs (FIG. 4B). Importantly, use of a tru-gRNA for VEGFA site 1 in place of a full-length gRNA did not affect the efficacy of the dual nickase approach to induce indel mutations (FIG. 4B).

The dual nickase strategy has also been used to stimulate the introduction of specific sequence changes using ssODNs (Mali et al., 2013a; Ran et al., 2013) and so whether tru-gRNAs might be used for this type of alteration was also tested. Paired full-length gRNAs for VEGFA sites 1 and 4 together with Cas9-D10A nickase cooperatively enhanced efficient introduction of a short insertion from a ssODN donor (FIG. 3A) into the VEGFA locus in human U2OS.EGFP cells as expected (FIG. 3C). Again, the efficiency of ssODN-mediated sequence alteration by dual nicking remained equally high with the use of a tru-gRNA in place of the full-length gRNA targeted to VEGFA site 1 (FIG. 3C). Taken together, these results demonstrate that tru-gRNAs can be utilized as part of a dual Cas9 nickase strategy to induce both indel mutations and ssODN-mediated sequence changes, without compromising the efficiency of genome editing by this approach.

Having established that use of a tru-gRNA does not diminish the on-target genome editing activities of paired nickases, we next used deep sequencing to examine mutation frequencies at four previously identified bona fide off-target sites of the VEGFA site 1 gRNA. This analysis revealed that mutation rates dropped to essentially undetectable levels at all four of these off-target sites when using paired nickases with a tru-gRNA (Table 4). By contrast, neither a tru-RGN (Table 3B) nor the paired nickases with full-length gRNAs (Table 4) was able to completely eliminate off-target mutations at one of these four off-target sites (OT1-3). These results demonstrate that the use of tru-gRNAs can further reduce the off-target effects of paired Cas9 nickases (and vice versa) without compromising the efficiency of on-target genome editing.

TABLE 4

Frequencies of paired nickase-induced indel mutations at on- and off-target sites of VEGFA site 1 using full-length and tru-gRNAs

| Site | Paired full-length gRNAs | | | tru-gRNA/full-length gRNA | | | Control | | |
|---|---|---|---|---|---|---|---|---|---|
| | Indel | WT | Freq. | Indel | WT | Freq. | Indel | WT | Freq. |
| VEGFA site 1 | 78905 | 345696 | 18.583% | 65754 | 280720 | 18.978% | 170 | 308478 | 0.055% |
| OT1-3 | 184 | 85151 | 0.216% | 0 | 78658 | 0.000% | 2 | 107850 | 0.002% |
| OT1-4 | 0 | 89209 | 0.000% | 1 | 97010 | 0.001% | 0 | 102135 | 0.000% |
| OT1-6 | 2 | 226575 | 0.001% | 0 | 208218 | 0.000% | 0 | 254580 | 0.000% |
| OT1-11 | 0 | 124729 | 0.000% | 0 | 121581 | 0.000% | 0 | 155173 | 0.000% |

REFERENCES

Cheng, A. W., Wang, H., Yang, H., Shi, L., Katz, Y., Theunissen, T. W., Rangarajan, S., Shivalila, C. S., Dadon, D. B., and Jaenisch, R. Multiplexed activation of endogenous genes by CRISPR-on, an RNA-guided transcriptional activator system. Cell Res 23, 1163-1171. (2013).

Cho, S. W., Kim, S., Kim, J. M. & Kim, J. S. Targeted genome engineering in human cells with the Cas9 RNA-guided endonuclease. Nat Biotechnol 31, 230-232 (2013).

Cong, L. et al. Multiplex genome engineering using CRISPR/Cas systems. Science 339, 819-823 (2013).

Cradick, T. J., Fine, E. J., Antico, C. J., and Bao, G. CRISPR/Cas9 systems targeting beta-globin and CCR5 genes have substantial off-target activity. Nucleic Acids Res. (2013).

Dicarlo, J. E. et al. Genome engineering in *Saccharomyces cerevisiae* using CRISPR-Cas systems. Nucleic Acids Res (2013).

Ding, Q., Regan, S. N., Xia, Y., Oostrom, L. A., Cowan, C. A., and Musunuru, K. Enhanced efficiency of human pluripotent stem cell genome editing through replacing TALENs with CRISPRs. Cell Stem Cell 12, 393-394. (2013).

Fisher, S., Barry, A., Abreu, J., Minie, B., Nolan, J., Delorey, T. M., Young, G., Fennell, T. J., Allen, A., Ambrogio, L., et al. A scalable, fully automated process for construction of sequence-ready human exome targeted capture libraries. Genome Biol 12, R1. (2011).

Friedland, A. E., Tzur, Y. B., Esvelt, K. M., Colaiacovo, M. P., Church, G. M., and Calarco, J. A. Heritable genome editing in C. elegans via a CRISPR-Cas9 system. Nat Methods 10, 741-743. (2013).

Fu, Y., Foden, J. A., Khayter, C., Maeder, M. L., Reyon, D., Joung, J. K., and Sander, J. D. High-frequency off-target mutagenesis induced by CRISPR-Cas nucleases in human cells. Nat Biotechnol 31, 822-826. (2013).

Gabriel, R. et al. An unbiased genome-wide analysis of zinc-finger nuclease specificity. Nat Biotechnol 29, 816-823 (2011).

Gilbert, L. A., Larson, M. H., Morsut, L., Liu, Z., Brar, G. A., Torres, S. E., Stern-Ginossar, N., Brandman, O., Whitehead, E. H., Doudna, J. A., et al. (2013). CRISPR-Mediated Modular RNA-Guided Regulation of Transcription in Eukaryotes. Cell 154, 442-451.

Gratz, S. J. et al. Genome engineering of Drosophila with the CRISPR RNA-guided Cas9 nuclease. Genetics (2013).

Hockemeyer, D. et al. Genetic engineering of human pluripotent cells using TALE nucleases. Nat Biotechnol 29, 731-734 (2011).

Horvath, P. & Barrangou, R. CRISPR/Cas, the immune system of bacteria and archaea. Science 327, 167-170 (2010).

Hsu, P. D., Scott, D. A., Weinstein, J. A., Ran, F. A., Konermann, S., Agarwala, V., Li, Y., Fine, E. J., Wu, X., Shalem, O., et al. DNA targeting specificity of RNA-guided Cas9 nucleases. Nat Biotechnol 31, 827-832. (2013).

Hwang, W. Y. et al. Efficient genome editing in zebrafish using a CRISPR-Cas system. Nat Biotechnol 31, 227-229 (2013).

Hwang, W. Y., Fu, Y., Reyon, D., Maeder, M. L., Kaini, P., Sander, J. D., Joung, J. K., Peterson, R. T., and Yeh, J. R. Heritable and Precise Zebrafish Genome Editing Using a CRISPR-Cas System. PLoS One 8, e68708. (2013a).

Jiang, W., Bikard, D., Cox, D., Zhang, F. & Marraffini, L. A. RNA-guided editing of bacterial genomes using CRISPR-Cas systems. Nat Biotechnol 31, 233-239 (2013).

Jinek, M. et al. A programmable dual-RNA-guided DNA endonuclease in adaptive bacterial immunity. Science 337, 816-821 (2012).

Jinek, M. et al. RNA-programmed genome editing in human cells. Elife 2, e00471 (2013).

Li, D., Qiu, Z., Shao, Y., Chen, Y., Guan, Y., Liu, M., Li, Y., Gao, N., Wang, L., Lu, X., et al. Heritable gene targeting in the mouse and rat using a CRISPR-Cas system. Nat Biotechnol 31, 681-683. (2013a).

Li, W., Teng, F., Li, T., and Zhou, Q. Simultaneous generation and germline transmission of multiple gene mutations in rat using CRISPR-Cas systems. Nat Biotechnol 31, 684-686. (2013b).

Maeder, M. L., Linder, S. J., Cascio, V. M., Fu, Y., Ho, Q. H., and Joung, J. K. CRISPR RNA-guided activation of endogenous human genes. Nat Methods 10, 977-979. (2013).

Mali, P., Aach, J., Stranges, P. B., Esvelt, K. M., Moosburner, M., Kosuri, S., Yang, L., and Church, G. M. CAS9 transcriptional activators for target specificity screening and paired nickases for cooperative genome engineering. Nat Biotechnol 31, 833-838. (2013a).

Mali, P., Esvelt, K. M., and Church, G. M. Cas9 as a versatile tool for engineering biology. Nat Methods 10, 957-963. (2013b).

Mali, P. et al. RNA-guided human genome engineering via Cas9. Science 339, 823-826 (2013c).

Pattanayak, V., Lin, S., Guilinger, J. P., Ma, E., Doudna, J. A., and Liu, D. R. High-throughput profiling of off-target DNA cleavage reveals RNA-programmed Cas9 nuclease specificity. Nat Biotechnol 31, 839-843. (2013).

Pattanayak, V., Ramirez, C. L., Joung, J. K. & Liu, D. R. Revealing off-target cleavage specificities of zinc-finger nucleases by in vitro selection. Nat Methods 8, 765-770 (2011).

Perez, E. E. et al. Establishment of HIV-1 resistance in CD4+ T cells by genome editing using zinc-finger nucleases. Nat Biotechnol 26, 808-816 (2008).

Perez-Pinera, P., Kocak, D. D., Vockley, C. M., Adler, A. F., Kabadi, A. M., Polstein, L. R., Thakore, P. I., Glass, K. A., Ousterout, D. G., Leong, K. W., et al. RNA-guided gene activation by CRISPR-Cas9-based transcription factors. Nat Methods 10, 973-976. (2013).

Qi, L. S., Larson, M. H., Gilbert, L. A., Doudna, J. A., Weissman, J. S., Arkin, A. P., and Lim, W. A. Repurposing CRISPR as an RNA-guided platform for sequence-specific control of gene expression. Cell 152, 1173-1183. (2013).

Ran, F. A., Hsu, P. D., Lin, C. Y., Gootenberg, J. S., Konermann, S., Trevino, A. E., Scott, D. A., Inoue, A., Matoba, S., Zhang, Y., et al. Double nicking by RNA-guided CRISPR Cas9 for enhanced genome editing specificity. Cell 154, 1380-1389. (2013).

Reyon, D. et al. FLASH assembly of TALENs for high-throughput genome editing. Nat Biotech 30, 460-465 (2012).

Sander, J. D., Maeder, M. L., Reyon, D., Voytas, D. F., Joung, J. K., and Dobbs, D. ZiFiT (Zinc Finger Targeter): an updated zinc finger engineering tool. Nucleic Acids Res 38, W462-468. (2010).

Sander, J. D., Ramirez, C. L., Linder, S. J., Pattanayak, V., Shoresh, N., Ku, M., Foden, J. A., Reyon, D., Bernstein, B. E., Liu, D. R., et al. In silico abstraction of zinc finger nuclease cleavage profiles reveals an expanded landscape of off-target sites. Nucleic Acids Res. (2013).

Sander, J. D., Zaback, P., Joung, J. K., Voytas, D. F., and Dobbs, D. Zinc Finger Targeter (ZiFiT): an engineered zinc finger/target site design tool. Nucleic Acids Res 35, W599-605. (2007).

Shen, B. et al. Generation of gene-modified mice via Cas9/RNA-mediated gene targeting. Cell Res (2013).

Sugimoto, N. et al. Thermodynamic parameters to predict stability of RNA/DNA hybrid duplexes. Biochemistry 34, 11211-11216 (1995).

Terns, M. P. & Terns, R. M. CRISPR-based adaptive immune systems. Curr Opin Microbiol 14, 321-327 (2011).

Wang, H. et al. One-Step Generation of Mice Carrying Mutations in Multiple Genes by CRISPR/Cas-Mediated Genome Engineering. Cell 153, 910-918 (2013).

Wiedenheft, B., Sternberg, S. H. & Doudna, J. A. RNA-guided genetic silencing systems in bacteria and archaea. Nature 482, 331-338 (2012).

Yang, L., Guell, M., Byrne, S., Yang, J. L., De Los Angeles, A., Mali, P., Aach, J., Kim-Kiselak, C., Briggs, A. W., Rios, X., et al. (2013). Optimization of scarless human stem cell genome editing. Nucleic Acids Res 41, 9049-9061.

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (3037 sequences)

SEQ ID NO: 1 - RNA, 261 nt, Artificial Sequence
  Description of Artificial Sequence: Synthetic guide RNA sequence
  modified_base (1)..(19): a, c, u, g, unknown or other and this region may encompass 17-18 or 17-19 nucleotides
  modified_base (62)..(261): a, c, u, g, unknown or other and this region may encompass 0-200 nucleotides
nnnnnnnnnnnnnnnnnnnguuuuagagcuagaaauagcaaguuaaaauaaggcuaguccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2 - RNA, 274 nt, Artificial Sequence
  Description of Artificial Sequence: Synthetic guide RNA sequence
  modified_base (1)..(19): a, c, u, g, unknown or other and this region may encompass 17-18 or 17-19 nucleotides
  modified_base (75)..(274): a, c, u, g, unknown or other and this region may encompass 0-200 nucleotides
nnnnnnnnnnnnnnnnnnnguuuuagagcuaugcugaaaagcauagcaaguuaaaauaaggcuaguccguuaucnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3 - RNA, 286 nt, Artificial Sequence
  Description of Artificial Sequence: Synthetic guide RNA sequence
  modified_base (1)..(19): a, c, u, g, unknown or other and this region may encompass 17-18 or 17-19 nucleotides
  modified_base (87)..(286): a, c, u, g, unknown or other and this region may encompass 0-200 nucleotides
nnnnnnnnnnnnnnnnnnnguuuuagagcuaugcuguuuuggaaacaaaacagcauagcaaguuaaaauaaggcuaguccguuaucnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4 - RNA, 294 nt, Artificial Sequence
  Description of Artificial Sequence: Synthetic guide RNA sequence
  modified_base (1)..(18): a, c, u, g, unknown or other and this region may encompass 17-18 nucleotides
  modified_base (95)..(294): a, c, u, g, unknown or other and this region may encompass 0-200 nucleotides
nnnnnnnnnnnnnnnnnnguuuuagagcuagaaauagcaaguuaaaauaaggcuaguccguuaucaacuugaaaaaguggcaccgagucggugcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5 - RNA, 95 nt, Artificial Sequence
  Description of Artificial Sequence: Synthetic guide RNA sequence
  modified_base (1)..(19): a, c, u, g, unknown or other and this region may encompass 17-18 or 17-19 nucleotides
nnnnnnnnnnnnnnnnnnnguuuaagagcuagaaauagcaaguuuaaauaaggcuaguccguuaucaacuugaaaaaguggcaccgagucggugc

SEQ ID NO: 6 - RNA, 105 nt, Artificial Sequence
  Description of Artificial Sequence: Synthetic guide RNA sequence
  modified_base (1)..(19): a, c, u, g, unknown or other and this region may encompass 17-18 or 17-19 nucleotides
nnnnnnnnnnnnnnnnnnnguuuuagagcuaugcuggaaacagcauagcaaguuuaaauaaggcuaguccguuaucaacuugaaaaaguggcaccgagucggugc

SEQ ID NO: 7 - RNA, 105 nt, Artificial Sequence
  Description of Artificial Sequence: Synthetic guide RNA sequence
  modified_base (1)..(19): a, c, u, g, unknown or other and this region may encompass 17-18 or 17-19 nucleotides
nnnnnnnnnnnnnnnnnnnguuuaagagcuaugcuggaaacagcauagcaaguuuaaauaaggcuaguccguuaucaacuugaaaaaguggcaccgagucggugc

SEQ ID NO: 8 - RNA, 79 nt, Artificial Sequence
  Description of Artificial Sequence: Synthetic tracrRNA sequence
ggaaccauucaaaacagcauagcaaguuaaaauaaggcuaguccguuaucaacuugaaaaaguggcaccgagucggugc

SEQ ID NO: 9 - DNA, 23 bp, Artificial Sequence
  Description of Artificial Sequence: Synthetic EGFP target site sequence
gggcacgggcagcttgccggtgg

SEQ ID NO: 10 - DNA, 23 bp, Artificial Sequence
  Description of Artificial Sequence: Synthetic EGFP target site sequence
gatgccgttcttctgcttgtcgg

SEQ ID NO: 11 - DNA, 23 bp, Artificial Sequence
  Description of Artificial Sequence: Synthetic EGFP target site sequence
ggtggtgcagatgaacttcaggg

SEQ ID NO: 12 - DNA, 23 bp, Artificial Sequence
  Description of Artificial Sequence: Synthetic VEGFA on-target sequence
gaccccctccaccccgcctccgg

SEQ ID NO: 13 - DNA, 23 bp, Artificial Sequence
  Description of Artificial Sequence: Synthetic VEGFA off-target sequence
gaccccccccaccccgcccccgg

SEQ ID NO: 14 - DNA, 23 bp, Artificial Sequence
  Description of Artificial Sequence: Synthetic VEGFA off-target sequence
gggcccctccaccccgcctctgg

SEQ ID NO: 15 - DNA, 23 bp, Artificial Sequence
  Description of Artificial Sequence: Synthetic VEGFA off-target sequence
ctacccctccaccccgcctccgg

SEQ ID NO: 16 - DNA, 23 bp, Artificial Sequence
  Description of Artificial Sequence: Synthetic VEGFA off-target sequence
gcccccacccaccccgcctctgg

SEQ ID NO: 17 - DNA, 23 bp, Artificial Sequence
  Description of Artificial Sequence: Synthetic VEGFA off-target sequence
taccccccacaccccgcctctgg

SEQ ID NO: 18 - DNA, 23 bp, Artificial Sequence
  Description of Artificial Sequence: Synthetic VEGFA off-target sequence
acacccccccaccccgcctcagg

SEQ ID NO: 19 - DNA, 23 bp, Artificial Sequence
  Description of Artificial Sequence: Synthetic VEGFA off-target sequence
attcccccccaccccgcctcagg

SEQ ID NO: 20 - DNA, 23 bp, Artificial Sequence
  Description of Artificial Sequence: Synthetic VEGFA off-target sequence
ccccacccccaccccgcctcagg

SEQ ID NO: 21 - DNA, 23 bp, Artificial Sequence
  Description of Artificial Sequence: Synthetic VEGFA off-target sequence
cgccctccccaccccgcctccgg

SEQ ID NO: 22 - DNA, 23 bp, Artificial Sequence
  Description of Artificial Sequence: Synthetic VEGFA off-target sequence
ctccccacccaccccgcctcagg

SEQ ID NO: 23 - DNA, 23 bp, Artificial Sequence
  Description of Artificial Sequence: Synthetic VEGFA off-target sequence
tgcccctcccaccccgcctctgg

SEQ ID NO: 24 - DNA, 23 bp, Artificial Sequence
  Description of Artificial Sequence: Synthetic VEGFA off-target sequence
aggcccccacaccccgcctcagg

SEQ ID NO: 25 - DNA, 23 bp, Artificial Sequence
  Description of Artificial Sequence: Synthetic VEGFA on-target sequence
ggtgagtgagtgtgtgcgtgtgg

SEQ ID NO: 26 - DNA, 23 bp, Artificial Sequence
  Description of Artificial Sequence: Synthetic VEGFA off-target sequence
ggtgagtgagtgtgtgtgtgagg

SEQ ID NO: 27 - DNA, 23 bp, Artificial Sequence
  Description of Artificial Sequence: Synthetic VEGFA off-target sequence
agtgagtgagtgtgtgtgtgggg

SEQ ID NO: 28 - DNA, 23 bp, Artificial Sequence
  Description of Artificial Sequence: Synthetic VEGFA off-target sequence
gctgagtgagtgtatgcgtgtgg

SEQ ID NO: 29 - DNA, 23 bp, Artificial Sequence
  Description of Artificial Sequence: Synthetic VEGFA off-target sequence
ggtgagtgagtgcgtgcgggtgg

SEQ ID NO: 30 - DNA, 23 bp, Artificial Sequence
  Description of Artificial Sequence: Synthetic VEGFA off-target sequence
gttgagtgaatgtgtgcgtgagg

SEQ ID NO: 31 - DNA, 23 bp, Artificial Sequence
  Description of Artificial Sequence: Synthetic VEGFA off-target sequence
tgtgggtgagtgtgtgcgtgagg

SEQ ID NO: 32 - DNA, 23 bp, Artificial Sequence
  Description of Artificial Sequence: Synthetic VEGFA off-target sequence
agagagtgagtgtgtgcatgagg

SEQ ID NO: 33 - protein, 1368 aa, Artificial Sequence
  Description of Artificial Sequence: Synthetic catalytically inactive Cas9 polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 34 - protein, 4 aa, Artificial Sequence
  Description of Artificial Sequence: Synthetic linker sequence
GGGS

SEQ ID NO: 35 - protein, 5 aa, Artificial Sequence
  Description of Artificial Sequence: Synthetic linker sequence
GGGGS

SEQ ID NO: 36 - DNA, 26 bp, Artificial Sequence
  Description of Artificial Sequence: Synthetic oligonucleotide for constructing gRNA expression plasmid
acaccgggcacgggcagcttgccggg

SEQ ID NO: 37 - DNA, 26 bp, Artificial Sequence
  Description of Artificial Sequence: Synthetic oligonucleotide for constructing gRNA expression plasmid
acaccgggcacgggcagcttgccgcg

SEQ ID NO: 38 - DNA, 26 bp, Artificial Sequence
  Description of Artificial Sequence: Synthetic oligonucleotide for constructing gRNA expression plasmid
acaccgggcacgggcagcttgcccgg

SEQ ID NO: 39 - DNA, 26 bp, Artificial Sequence
  Description of Artificial Sequence: Synthetic oligonucleotide for constructing gRNA expression plasmid
acaccgggcacgggcagcttgcgggg

SEQ ID NO: 40 - DNA, 26 bp, Artificial Sequence
  Description of Artificial Sequence: Synthetic oligonucleotide for constructing gRNA expression plasmid
acaccgggcacgggcagcttggcggg

SEQ ID NO: 41 - DNA, 26 bp, Artificial Sequence
  Description of Artificial Sequence: Synthetic oligonucleotide for constructing gRNA expression plasmid
acaccgggcacgggcagcttcccggg

SEQ ID NO: 42 - DNA, 26 bp, Artificial Sequence
  Description of Artificial Sequence: Synthetic oligonucleotide for constructing gRNA expression plasmid
acaccgggcacgggcagctagccggg

SEQ ID NO: 43 - DNA, 26 bp, Artificial Sequence
  Description of Artificial Sequence: Synthetic oligonucleotide for constructing gRNA expression plasmid
acaccgggcacgggcagcatgccggg

SEQ ID NO: 44 - DNA, 26 bp, Artificial Sequence
  Description of Artificial Sequence: Synthetic oligonucleotide for constructing gRNA expression plasmid
acaccgggcacgggcaggttgccggg

SEQ ID NO: 45 - DNA, 26 bp, Artificial Sequence
  Description of Artificial Sequence: Synthetic oligonucleotide for constructing gRNA expression plasmid
acaccgggcacgggcaccttgccggg

SEQ ID NO: 46 - DNA, 26 bp, Artificial Sequence
  Description of Artificial Sequence: Synthetic oligonucleotide for constructing gRNA expression plasmid
acaccgggcacgggctgcttgccggg

SEQ ID NO: 47 - DNA, 26 bp, Artificial Sequence
  Description of Artificial Sequence: Synthetic oligonucleotide for constructing gRNA expression plasmid
acaccgggcacggggagcttgccggg

SEQ ID NO: 48 - DNA, 26 bp, Artificial Sequence
  Description of Artificial Sequence: Synthetic oligonucleotide for constructing gRNA expression plasmid
acaccgggcacggccagcttgccggg

SEQ ID NO: 49 - DNA, 26 bp, Artificial Sequence
  Description of Artificial Sequence: Synthetic oligonucleotide for constructing gRNA expression plasmid
acaccgggcacgcgcagcttgccggg

SEQ ID NO: 50 - DNA, 26 bp, Artificial Sequence
  Description of Artificial Sequence: Synthetic oligonucleotide for constructing gRNA expression plasmid
acaccgggcaccggcagcttgccggg

SEQ ID NO: 51 - DNA, 26 bp, Artificial Sequence
  Description of Artificial Sequence: Synthetic oligonucleotide for constructing gRNA expression plasmid
acaccgggcaggggcagcttgccggg

SEQ ID NO: 52 - DNA, 26 bp, Artificial Sequence
  Description of Artificial Sequence: Synthetic oligonucleotide for constructing gRNA expression plasmid
acaccgggctcgggcagcttgccggg

SEQ ID NO: 53 - DNA, 26 bp, Artificial Sequence
  Description of Artificial Sequence: Synthetic oligonucleotide for constructing gRNA expression plasmid
acaccggggacgggcagcttgccggg

SEQ ID NO: 54 - DNA, 26 bp, Artificial Sequence
  Description of Artificial Sequence: Synthetic oligonucleotide for constructing gRNA expression plasmid
acaccggccacgggcagcttgccggg

SEQ ID NO: 55 - DNA, 26 bp, Artificial Sequence
  Description of Artificial Sequence: Synthetic oligonucleotide for constructing gRNA expression plasmid
acaccgcgcacgggcagcttgccggg

SEQ ID NO: 56 - DNA, 26 bp, Artificial Sequence
  Description of Artificial Sequence: Synthetic oligonucleotide for constructing gRNA expression plasmid
acaccgggcacgggcagcttgccccg

SEQ ID NO: 57 - DNA, 26 bp, Artificial Sequence
  Description of Artificial Sequence: Synthetic oligonucleotide for constructing gRNA expression plasmid
acaccgggcacgggcagcttgggggg

SEQ ID NO: 58 - DNA, 26 bp, Artificial Sequence
  Description of Artificial Sequence: Synthetic oligonucleotide for constructing gRNA expression plasmid
acaccgggcacgggcagctacccggg

SEQ ID NO: 59 - DNA, 26 bp, Artificial Sequence
  Description of Artificial Sequence: Synthetic oligonucleotide for constructing gRNA expression plasmid
acaccgggcacgggcaggatgccggg

SEQ ID NO: 60 - DNA, 26 bp, Artificial Sequence
  Description of Artificial Sequence: Synthetic oligonucleotide for constructing gRNA expression plasmid
acaccgggcacgggctccttgccggg

SEQ ID NO: 61 - DNA, 26 bp, Artificial Sequence
  Description of Artificial Sequence: Synthetic oligonucleotide for constructing gRNA expression plasmid
acaccgggcacggcgagcttgccggg

SEQ ID NO: 62 - DNA, 26 bp, Artificial Sequence
  Description of Artificial Sequence: Synthetic oligonucleotide for constructing gRNA expression plasmid
acaccgggcacccgcagcttgccggg

SEQ ID NO: 63 - DNA, 26 bp, Artificial Sequence
  Description of Artificial Sequence: Synthetic oligonucleotide for constructing gRNA expression plasmid
acaccgggctggggcagcttgccggg

SEQ ID NO: 64 - DNA, 26 bp, Artificial Sequence
  Description of Artificial Sequence: Synthetic oligonucleotide for constructing gRNA expression plasmid
acaccggcgacgggcagcttgccggg

SEQ ID NO: 65 - DNA, 26 bp, Artificial Sequence
  Description of Artificial Sequence: Synthetic oligonucleotide for constructing gRNA expression plasmid
acaccgcccacgggcagcttgccggg

SEQ ID NO: 66 - DNA, 26 bp, Artificial Sequence
  Description of Artificial Sequence: Synthetic oligonucleotide for constructing gRNA expression plasmid
acaccgccgacgggcagcttgccggg

SEQ ID NO: 67 - DNA, 26 bp, Artificial Sequence
  Description of Artificial Sequence: Synthetic oligonucleotide for constructing gRNA expression plasmid
acaccgccgtcgggcagcttgccggg

SEQ ID NO: 68 - DNA, 26 bp, Artificial Sequence
  Description of Artificial Sequence: Synthetic oligonucleotide for constructing gRNA expression plasmid
acaccgccgtggggcagcttgccggg

SEQ ID NO: 69 - DNA, 26 bp, Artificial Sequence
  Description of Artificial Sequence: Synthetic oligonucleotide for constructing gRNA expression plasmid
acaccgccgtgcggcagcttgccggg

SEQ ID NO: 70 - DNA, 26 bp, Artificial Sequence
  Description of Artificial Sequence: Synthetic oligonucleotide for constructing gRNA expression plasmid
acaccgccgtgccgcagcttgccggg

SEQ ID NO: 71 - DNA, 26 bp, Artificial Sequence
  Description of Artificial Sequence: Synthetic oligonucleotide for constructing gRNA expression plasmid
acaccgccgtgccccagcttgccggg

SEQ ID NO: 72 - DNA, 26 bp, Artificial Sequence
  Description of Artificial Sequence: Synthetic oligonucleotide for constructing gRNA expression plasmid
acaccgccgtgcccgagcttgccggg

SEQ ID NO: 73 - DNA, 26 bp, Artificial Sequence
  Description of Artificial Sequence: Synthetic oligonucleotide for constructing gRNA expression plasmid
acaccgggcacgggcagcttgcggcg

SEQ ID NO: 74 - DNA, 26 bp, Artificial Sequence
  Description of Artificial Sequence: Synthetic oligonucleotide for constructing gRNA expression plasmid
acaccgggcacgggcagcttccgggg

SEQ ID NO: 75 - DNA, 26 bp, Artificial Sequence
  Description of Artificial Sequence: Synthetic oligonucleotide for constructing gRNA expression plasmid
acaccgggcacgggcagcatgcgggg

SEQ ID NO: 76 - DNA, 26 bp, Artificial Sequence
  Description of Artificial Sequence: Synthetic oligonucleotide for constructing gRNA expression plasmid
acaccgggcacgggcaccttgcgggg

SEQ ID NO: 77 - DNA, 26 bp, Artificial Sequence
  Description of Artificial Sequence: Synthetic oligonucleotide for constructing gRNA expression plasmid
acaccgggcacggggagcttgcgggg

SEQ ID NO: 78 - DNA, 26 bp, Artificial Sequence
  Description of Artificial Sequence: Synthetic oligonucleotide for constructing gRNA expression plasmid
acaccgggcacgcgcagcttgcgggg

SEQ ID NO: 79 - DNA, 26 bp, Artificial Sequence
  Description of Artificial Sequence: Synthetic oligonucleotide for constructing gRNA expression plasmid
acaccgggcaggggcagcttgcgggg

SEQ ID NO: 80 - DNA, 26 bp, Artificial Sequence
  Description of Artificial Sequence: Synthetic oligonucleotide for constructing gRNA expression plasmid
acaccggggacgggcagcttgcgggg

SEQ ID NO: 81 - DNA, 26 bp, Artificial Sequence
  Description of Artificial Sequence: Synthetic oligonucleotide for constructing gRNA expression plasmid
acaccgcgcacgggcagcttgcgggg

SEQ ID NO: 82 - DNA, 26 bp, Artificial Sequence
  Description of Artificial Sequence: Synthetic oligonucleotide for constructing gRNA expression plasmid
acaccgggcacggggagcttgccgcg

SEQ ID NO: 83 - DNA, 26 bp, Artificial Sequence
  Description of Artificial Sequence: Synthetic oligonucleotide for constructing gRNA expression plasmid
acaccgggcacggggagcttcccggg

SEQ ID NO: 84 - DNA, 26 bp, Artificial Sequence
  Description of Artificial Sequence: Synthetic oligonucleotide for constructing gRNA expression plasmid
acaccgggcacggggagcatgccggg

SEQ ID NO: 85 - DNA, 26 bp, Artificial Sequence
  Description of Artificial Sequence: Synthetic oligonucleotide for constructing gRNA expression plasmid
acaccgggcacggggaccttgccggg

SEQ ID NO: 86 - DNA, 26 bp, Artificial Sequence
  Description of Artificial Sequence: Synthetic oligonucleotide for constructing gRNA expression plasmid
acaccgggcacgcggagcttgccggg

SEQ ID NO: 87 - DNA, 26 bp, Artificial Sequence
  Description of Artificial Sequence: Synthetic oligonucleotide for constructing gRNA expression plasmid
acaccgggcagggggagcttgccggg

SEQ ID NO: 88 - DNA, 26 bp, Artificial Sequence
  Description of Artificial Sequence: Synthetic oligonucleotide for constructing gRNA expression plasmid
acaccggggacggggagcttgccggg

SEQ ID NO: 89 - DNA, 26 bp, Artificial Sequence
  Description of Artificial Sequence: Synthetic oligonucleotide for constructing gRNA expression plasmid
acaccgcgcacggggagcttgccggg

SEQ ID NO: 90 - DNA, 26 bp, Artificial Sequence
  Description of Artificial Sequence: Synthetic oligonucleotide for constructing gRNA expression plasmid
acaccgcgcacgggcagcttgccgcg

SEQ ID NO: 91 - DNA, 26 bp, Artificial Sequence
  Description of Artificial Sequence: Synthetic oligonucleotide for constructing gRNA expression plasmid
acaccgcgcacgggcagcttcccggg

SEQ ID NO: 92 - DNA, 26 bp, Artificial Sequence
  Description of Artificial Sequence: Synthetic oligonucleotide for constructing gRNA expression plasmid
acaccgcgcacgggcagcatgccggg

SEQ ID NO: 93 - DNA, 26 bp, Artificial Sequence
  Description of Artificial Sequence: Synthetic oligonucleotide for constructing gRNA expression plasmid
acaccgcgcacgggcaccttgccggg

SEQ ID NO: 94 - DNA, 26 bp, Artificial Sequence
  Description of Artificial Sequence: Synthetic oligonucleotide for constructing gRNA expression plasmid
acaccgcgcacgcgcagcttgccggg

SEQ ID NO: 95 - DNA, 26 bp, Artificial Sequence
  Description of Artificial Sequence: Synthetic oligonucleotide for constructing gRNA expression plasmid
acaccgcgcaggggcagcttgccggg

SEQ ID NO: 96 - DNA, 26 bp, Artificial Sequence
  Description of Artificial Sequence: Synthetic oligonucleotide for constructing gRNA expression plasmid
acaccgcggacgggcagcttgccggg

SEQ ID NO: 97 - DNA, 26 bp, Artificial Sequence
  Description of Artificial Sequence: Synthetic oligonucleotide for constructing gRNA expression plasmid
acaccgatgccgttcttctgcttgtg

SEQ ID NO: 98 - DNA, 26 bp, Artificial Sequence
  Description of Artificial Sequence: Synthetic oligonucleotide for constructing gRNA expression plasmid
acaccgatgccgttcttctgcttgag

SEQ ID NO: 99 - DNA, 26 bp, Artificial Sequence
  Description of Artificial Sequence: Synthetic oligonucleotide for constructing gRNA expression plasmid
acaccgatgccgttcttctgcttctg

SEQ ID NO: 100 - DNA, 26 bp, Artificial Sequence
  Description of Artificial Sequence: Synthetic oligonucleotide for constructing gRNA expression plasmid
acaccgatgccgttcttctgctagtg

SEQ ID NO: 101 - DNA, 26 bp, Artificial Sequence
  Description of Artificial Sequence: Synthetic oligonucleotide for constructing gRNA expression plasmid
acaccgatgccgttcttctgcatgtg

SEQ ID NO: 102 - DNA, 26 bp, Artificial Sequence
  Description of Artificial Sequence: Synthetic oligonucleotide for constructing gRNA expression plasmid
acaccgatgccgttcttctggttgtg

SEQ ID NO: 103 - DNA, 26 bp, Artificial Sequence
  Description of Artificial Sequence: Synthetic oligonucleotide for constructing gRNA expression plasmid
acaccgatgccgttcttctccttgtg

SEQ ID NO: 104 - DNA, 26 bp, Artificial Sequence
  Description of Artificial Sequence: Synthetic oligonucleotide for constructing gRNA expression plasmid
acaccgatgccgttcttcagcttgtg

SEQ ID NO: 105 - DNA, 26 bp, Artificial Sequence
  Description of Artificial Sequence: Synthetic oligonucleotide for constructing gRNA expression plasmid
acaccgatgccgttcttgtgcttgtg

SEQ ID NO: 106 - DNA, 26 bp, Artificial Sequence
  Description of Artificial Sequence: Synthetic oligonucleotide for constructing gRNA expression plasmid
acaccgatgccgttctactgcttgtg

SEQ ID NO: 107 - DNA, 26 bp, Artificial Sequence
  Description of Artificial Sequence: Synthetic oligonucleotide for constructing gRNA expression plasmid
acaccgatgccgttcatctgcttgtg

SEQ ID NO: 108 - DNA, 26 bp, Artificial Sequence
  Description of Artificial Sequence: Synthetic oligonucleotide for constructing gRNA expression plasmid
acaccgatgccgttgttctgcttgtg

SEQ ID NO: 109 - DNA, 26 bp, Artificial Sequence
  Description of Artificial Sequence: Synthetic oligonucleotide for constructing gRNA expression plasmid
acaccgatgccgtacttctgcttgtg

SEQ ID NO: 110 - DNA, 26 bp, Artificial Sequence
  Description of Artificial Sequence: Synthetic oligonucleotide for constructing gRNA expression plasmid
acaccgatgccgatcttctgcttgtg

SEQ ID NO: 111 - DNA, 26 bp, Artificial Sequence
  Description of Artificial Sequence: Synthetic oligonucleotide for constructing gRNA expression plasmid
acaccgatgcccttcttctgcttgtg

SEQ ID NO: 112 - DNA, 26 bp, Artificial Sequence
  Description of Artificial Sequence: Synthetic oligonucleotide for constructing gRNA expression plasmid
acaccgatgcggttcttctgcttgtg

SEQ ID NO: 113 - DNA, 26 bp, Artificial Sequence
  Description of Artificial Sequence: Synthetic oligonucleotide for constructing gRNA expression plasmid
acaccgatggcgttcttctgcttgtg

SEQ ID NO: 114 - DNA, 26 bp, Artificial Sequence
  Description of Artificial Sequence: Synthetic oligonucleotide for constructing gRNA expression plasmid
acaccgatcccgttcttctgcttgtg

SEQ ID NO: 115 - DNA, 26 bp, Artificial Sequence
  Description of Artificial Sequence: Synthetic oligonucleotide for constructing gRNA expression plasmid
acaccgaagccgttcttctgcttgtg

SEQ ID NO: 116 - DNA, 26 bp, Artificial Sequence
  Description of Artificial Sequence: Synthetic oligonucleotide for constructing gRNA expression plasmid
acaccgttgccgttcttctgcttgtg

SEQ ID NO: 117 - DNA, 26 bp, Artificial Sequence
  Description of Artificial Sequence: Synthetic oligonucleotide for constructing gRNA expression plasmid
acaccgatgccgttcttctgcttcag

SEQ ID NO: 118 - DNA, 26 bp, Artificial Sequence
  Description of Artificial Sequence: Synthetic oligonucleotide for constructing gRNA expression plasmid
acaccgatgccgttcttctgcaagtg

SEQ ID NO: 119 - DNA, 26 bp, Artificial Sequence
  Description of Artificial Sequence: Synthetic oligonucleotide for constructing gRNA expression plasmid
acaccgatgccgttcttctcgttgtg

SEQ ID NO: 120 - DNA, 26 bp, Artificial Sequence
  Description of Artificial Sequence: Synthetic oligonucleotide for constructing gRNA expression plasmid
acaccgatgccgttcttgagcttgtg

SEQ ID NO: 121 - DNA, 26 bp, Artificial Sequence
  Description of Artificial Sequence: Synthetic oligonucleotide for constructing gRNA expression plasmid
acaccgatgccgttcaactgcttgtg

SEQ ID NO: 122 - DNA, 26 bp, Artificial Sequence
  Description of Artificial Sequence: Synthetic oligonucleotide for constructing gRNA expression plasmid
acaccgatgccgtagttctgcttgtg

SEQ ID NO: 123 - DNA, 26 bp, Artificial Sequence
  Description of Artificial Sequence: Synthetic oligonucleotide for constructing gRNA expression plasmid
acaccgatgcccatcttctgcttgtg

SEQ ID NO: 124 - DNA, 26 bp, Artificial Sequence
  Description of Artificial Sequence: Synthetic oligonucleotide for constructing gRNA expression plasmid
acaccgatggggttcttctgcttgtg

SEQ ID NO: 125 - DNA, 26 bp, Artificial Sequence
  Description of Artificial Sequence: Synthetic oligonucleotide for constructing gRNA expression plasmid
acaccgaacccgttcttctgcttgtg

SEQ ID NO: 126 - DNA, 26 bp, Artificial Sequence
  Description of Artificial Sequence: Synthetic oligonucleotide for constructing gRNA expression plasmid
acaccgtagccgttcttctgcttgtg

SEQ ID NO: 127 - DNA, 26 bp, Artificial Sequence
  Description of Artificial Sequence: Synthetic oligonucleotide for constructing gRNA expression plasmid
acaccgtacccgttcttctgcttgtg

SEQ ID NO: 128 - DNA, 26 bp, Artificial Sequence
  Description of Artificial Sequence: Synthetic oligonucleotide for constructing gRNA expression plasmid
acaccgtacgcgttcttctgcttgtg

SEQ ID NO: 129 - DNA, 26 bp, Artificial Sequence
  Description of Artificial Sequence: Synthetic oligonucleotide for constructing gRNA expression plasmid
acaccgtacgggttcttctgcttgtg

SEQ ID NO: 130 - DNA, 26 bp, Artificial Sequence
  Description of Artificial Sequence: Synthetic oligonucleotide for constructing gRNA expression plasmid
acaccgtacggcttcttctgcttgtg

SEQ ID NO: 131 - DNA, 26 bp, Artificial Sequence
  Description of Artificial Sequence: Synthetic oligonucleotide for constructing gRNA expression plasmid
acaccgtacggcatcttctgcttgtg

SEQ ID NO: 132 - DNA, 26 bp, Artificial Sequence
  Description of Artificial Sequence: Synthetic oligonucleotide for constructing gRNA expression plasmid
acaccgtacggcaacttctgcttgtg

SEQ ID NO: 133 - DNA, 26 bp, Artificial Sequence
  Description of Artificial Sequence: Synthetic oligonucleotide for constructing gRNA expression plasmid
acaccgtacggcaagttctgcttgtg

SEQ ID NO: 134 - DNA, 26 bp, Artificial Sequence
  Description of Artificial Sequence: Synthetic oligonucleotide for constructing gRNA expression plasmid
acaccgatgccgttcttctgctagag

SEQ ID NO: 135 - DNA, 26 bp, Artificial Sequence
  Description of Artificial Sequence: Synthetic oligonucleotide for constructing gRNA expression plasmid
acaccgatgccgttcttctggtagtg

SEQ ID NO: 136 - DNA, 26 bp, Artificial Sequence
  Description of Artificial Sequence: Synthetic oligonucleotide for constructing gRNA expression plasmid
acaccgatgccgttcttcagctagtg

SEQ ID NO: 137 - DNA, 26 bp, Artificial Sequence
  Description of Artificial Sequence: Synthetic oligonucleotide for constructing gRNA expression plasmid
acaccgatgccgttctactgctagtg

SEQ ID NO: 138 - DNA, 26 bp, Artificial Sequence
  Description of Artificial Sequence: Synthetic oligonucleotide for constructing gRNA expression plasmid
acaccgatgccgttgttctgctagtg

SEQ ID NO: 139 - DNA, 26 bp, Artificial Sequence
  Description of Artificial Sequence: Synthetic oligonucleotide for constructing gRNA expression plasmid
acaccgatgccgatcttctgctagtg

SEQ ID NO: 140 - DNA, 26 bp, Artificial Sequence
  Description of Artificial Sequence: Synthetic oligonucleotide for constructing gRNA expression plasmid
acaccgatgcggttcttctgctagtg

SEQ ID NO: 141 - DNA, 26 bp, Artificial Sequence
  Description of Artificial Sequence: Synthetic oligonucleotide for constructing gRNA expression plasmid
acaccgatcccgttcttctgctagtg

SEQ ID NO: 142 - DNA, 26 bp, Artificial Sequence
  Description of Artificial Sequence: Synthetic oligonucleotide for constructing gRNA expression plasmid
acaccgttgccgttcttctgctagtg

SEQ ID NO: 143 - DNA, 26 bp, Artificial Sequence
  Description of Artificial Sequence: Synthetic oligonucleotide for constructing gRNA expression plasmid
acaccgatgccgttgttctgcttgag

SEQ ID NO: 144 - DNA, 26 bp, Artificial Sequence
  Description of Artificial Sequence: Synthetic oligonucleotide for constructing gRNA expression plasmid
acaccgatgccgttgttctggttgtg

SEQ ID NO: 145 - DNA, 26 bp, Artificial Sequence
  Description of Artificial Sequence: Synthetic oligonucleotide for constructing gRNA expression plasmid
acaccgatgccgttgttcagcttgtg

SEQ ID NO: 146 - DNA, 26 bp, Artificial Sequence
  Description of Artificial Sequence: Synthetic oligonucleotide for constructing gRNA expression plasmid
acaccgatgccgttgtactgcttgtg

SEQ ID NO: 147 - DNA, 26 bp, Artificial Sequence
  Description of Artificial Sequence: Synthetic oligonucleotide for constructing gRNA expression plasmid
acaccgatgccgatgttctgcttgtg

SEQ ID NO: 148 - DNA, 26 bp, Artificial Sequence
  Description of Artificial Sequence: Synthetic oligonucleotide for constructing gRNA expression plasmid
acaccgatgcggttgttctgcttgtg

SEQ ID NO: 149 - DNA, 26 bp, Artificial Sequence
  Description of Artificial Sequence: Synthetic oligonucleotide for constructing gRNA expression plasmid
acaccgatcccgttgttctgcttgtg

SEQ ID NO: 150 - DNA, 26 bp, Artificial Sequence
  Description of Artificial Sequence: Synthetic oligonucleotide for constructing gRNA expression plasmid
acaccgttgccgttgttctgcttgtg

SEQ ID NO: 151 - DNA, 26 bp, Artificial Sequence
  Description of Artificial Sequence: Synthetic oligonucleotide for constructing gRNA expression plasmid
acaccgttgccgttcttctgcttgag

SEQ ID NO: 152 - DNA, 26 bp, Artificial Sequence
  Description of Artificial Sequence: Synthetic oligonucleotide for constructing gRNA expression plasmid
acaccgttgccgttcttctggttgtg

SEQ ID NO: 153 - DNA, 26 bp, Artificial Sequence
  Description of Artificial Sequence: Synthetic oligonucleotide for constructing gRNA expression plasmid
acaccgttgccgttcttcagcttgtg

SEQ ID NO: 154 - DNA, 26 bp, Artificial Sequence
  Description of Artificial Sequence: Synthetic oligonucleotide for constructing gRNA expression plasmid
acaccgttgccgttctactgcttgtg

SEQ ID NO: 155 - DNA, 26 bp, Artificial Sequence
  Description of Artificial Sequence: Synthetic oligonucleotide for constructing gRNA expression plasmid
acaccgttgccgatcttctgcttgtg

SEQ ID NO: 156 - DNA, 26 bp, Artificial Sequence
  Description of Artificial Sequence: Synthetic oligonucleotide for constructing gRNA expression plasmid
acaccgttgcggttcttctgcttgtg

SEQ ID NO: 157 - DNA, 26 bp, Artificial Sequence
  Description of Artificial Sequence: Synthetic oligonucleotide for constructing gRNA expression plasmid
acaccgttcccgttcttctgcttgtg

SEQ ID NO: 158 - DNA, 26 bp, Artificial Sequence
  Description of Artificial Sequence: Synthetic oligonucleotide for constructing gRNA expression plasmid
acaccggtggtgcagatgaacttcag

SEQ ID NO: 159 - DNA, 26 bp, Artificial Sequence
  Description of Artificial Sequence: Synthetic oligonucleotide for constructing gRNA expression plasmid
acaccggtggtgcagatgaacttctg

SEQ ID NO: 160 - DNA, 26 bp, Artificial Sequence
  Description of Artificial Sequence: Synthetic oligonucleotide for constructing gRNA expression plasmid
acaccggtggtgcagatgaacttgag

SEQ ID NO: 161 - DNA, 26 bp, Artificial Sequence
  Description of Artificial Sequence: Synthetic oligonucleotide for constructing gRNA expression plasmid
acaccggtggtgcagatgaactacag

SEQ ID NO: 162 - DNA, 26 bp, Artificial Sequence
  Description of Artificial Sequence: Synthetic oligonucleotide for constructing gRNA expression plasmid
acaccggtggtgcagatgaacatcag

SEQ ID NO: 163 - DNA, 26 bp, Artificial Sequence
  Description of Artificial Sequence: Synthetic oligonucleotide for constructing gRNA expression plasmid
acaccggtggtgcagatgaagttcag

SEQ ID NO: 164 - DNA, 26 bp, Artificial Sequence
  Description of Artificial Sequence: Synthetic oligonucleotide for constructing gRNA expression plasmid
acaccggtggtgcagatgatcttcag

SEQ ID NO: 165 - DNA, 26 bp, Artificial Sequence
  Description of Artificial Sequence: Synthetic oligonucleotide for constructing gRNA expression plasmid
acaccggtggtgcagatgtacttcag

SEQ ID NO: 166 - DNA, 26 bp, Artificial Sequence
  Description of Artificial Sequence: Synthetic oligonucleotide for constructing gRNA expression plasmid
acaccggtggtgcagatcaacttcag

SEQ ID NO: 167 - DNA, 26 bp, Artificial Sequence
  Description of Artificial Sequence: Synthetic oligonucleotide for constructing gRNA expression plasmid
acaccggtggtgcagaagaacttcag

SEQ ID NO: 168 - DNA, 26 bp, Artificial Sequence
  Description of Artificial Sequence: Synthetic oligonucleotide for constructing gRNA expression plasmid
acaccggtggtgcagttgaacttcag

SEQ ID NO: 169 - DNA, 26 bp, Artificial Sequence
  Description of Artificial Sequence: Synthetic oligonucleotide for constructing gRNA expression plasmid
acaccggtggtgcacatgaacttcag

SEQ ID NO: 170 - DNA, 26 bp, Artificial Sequence
  Description of Artificial Sequence: Synthetic oligonucleotide for constructing gRNA expression plasmid
acaccggtggtgctgatgaacttcag

SEQ ID NO: 171 - DNA, 26 bp, Artificial Sequence
  Description of Artificial Sequence: Synthetic oligonucleotide for constructing gRNA expression plasmid
acaccggtggtggagatgaacttcag

SEQ ID NO: 172 - DNA, 26 bp, Artificial Sequence
  Description of Artificial Sequence: Synthetic oligonucleotide for constructing gRNA expression plasmid
acaccggtggtccagatgaacttcag

SEQ ID NO: 173 - DNA, 26 bp, Artificial Sequence
  Description of Artificial Sequence: Synthetic oligonucleotide for constructing gRNA expression plasmid
acaccggtggagcagatgaacttcag

SEQ ID NO: 174 - DNA, 26 bp, Artificial Sequence
  Description of Artificial Sequence: Synthetic oligonucleotide for constructing gRNA expression plasmid
acaccggtgctgcagatgaacttcag

SEQ ID NO: 175 - DNA, 26 bp, Artificial Sequence
  Description of Artificial Sequence: Synthetic oligonucleotide for constructing gRNA expression plasmid
acaccggtcgtgcagatgaacttcag

SEQ ID NO: 176 - DNA, 26 bp, Artificial Sequence
  Description of Artificial Sequence: Synthetic oligonucleotide for constructing gRNA expression plasmid
acaccggaggtgcagatgaacttcag

SEQ ID NO: 177 - DNA, 26 bp, Artificial Sequence
  Description of Artificial Sequence: Synthetic oligonucleotide for constructing gRNA expression plasmid
acaccgctggtgcagatgaacttcag

SEQ ID NO: 178 - DNA, 26 bp, Artificial Sequence
  Description of Artificial Sequence: Synthetic oligonucleotide for constructing gRNA expression plasmid
acaccggtggtgcagatgaacttgtg

SEQ ID NO: 179 - DNA, 26 bp, Artificial Sequence
  Description of Artificial Sequence: Synthetic oligonucleotide for constructing gRNA expression plasmid
acaccggtggtgcagatgaacaacag

SEQ ID NO: 180 - DNA, 26 bp, Artificial Sequence
  Description of Artificial Sequence: Synthetic oligonucleotide for constructing gRNA expression plasmid
acaccggtggtgcagatgatgttcag

SEQ ID NO: 181 - DNA, 26 bp, Artificial Sequence
  Description of Artificial Sequence: Synthetic oligonucleotide for constructing gRNA expression plasmid
acaccggtggtgcagatctacttcag

SEQ ID NO: 182 - DNA, 26 bp, Artificial Sequence
  Description of Artificial Sequence: Synthetic oligonucleotide for constructing gRNA expression plasmid
acaccggtggtgcagtagaacttcag

SEQ ID NO: 183 - DNA, 26 bp, Artificial Sequence
  Description of Artificial Sequence: Synthetic oligonucleotide for constructing gRNA expression plasmid
acaccggtggtgctcatgaacttcag

SEQ ID NO: 184 - DNA, 26 bp, Artificial Sequence
  Description of Artificial Sequence: Synthetic oligonucleotide for constructing gRNA expression plasmid
acaccggtggtcgagatgaacttcag

SEQ ID NO: 185 - DNA, 26 bp, Artificial Sequence
  Description of Artificial Sequence: Synthetic oligonucleotide for constructing gRNA expression plasmid
acaccggtgcagcagatgaacttcag

SEQ ID NO: 186 - DNA, 26 bp, Artificial Sequence
  Description of Artificial Sequence: Synthetic oligonucleotide for constructing gRNA expression plasmid
acaccggacgtgcagatgaacttcag

SEQ ID NO: 187 - DNA, 26 bp, Artificial Sequence
  Description of Artificial Sequence: Synthetic oligonucleotide for constructing gRNA expression plasmid
acaccgcaggtgcagatgaacttcag

SEQ ID NO: 188 - DNA, 26 bp, Artificial Sequence
  Description of Artificial Sequence: Synthetic oligonucleotide for constructing gRNA expression plasmid
acaccgcacgtgcagatgaacttcag

SEQ ID NO: 189 - DNA, 26 bp, Artificial Sequence
  Description of Artificial Sequence: Synthetic oligonucleotide for constructing gRNA expression plasmid
acaccgcacctgcagatgaacttcag

SEQ ID NO: 190 - DNA, 26 bp, Artificial Sequence
  Description of Artificial Sequence: Synthetic oligonucleotide for constructing gRNA expression plasmid
acaccgcaccagcagatgaacttcag

SEQ ID NO: 191 - DNA, 26 bp, Artificial Sequence
  Description of Artificial Sequence: Synthetic oligonucleotide for constructing gRNA expression plasmid
acaccgcaccaccagatgaacttcag

SEQ ID NO: 192 - DNA, 26 bp, Artificial Sequence
  Description of Artificial Sequence: Synthetic oligonucleotide for constructing gRNA expression plasmid
acaccgcaccacgagatgaacttcag

SEQ ID NO: 193 - DNA, 26 bp, Artificial Sequence
  Description of Artificial Sequence: Synthetic oligonucleotide for constructing gRNA expression plasmid
acaccgcaccacgtgatgaacttcag

SEQ ID NO: 194 - DNA, 26 bp, Artificial Sequence
  Description of Artificial Sequence: Synthetic oligonucleotide for constructing gRNA expression plasmid
acaccgcaccacgtcatgaacttcag

SEQ ID NO: 195 - DNA, 26 bp, Artificial Sequence
  Description of Artificial Sequence: Synthetic oligonucleotide for constructing gRNA expression plasmid
acaccggtggtgcagatgaactactg

SEQ ID NO: 196 - DNA, 26 bp, Artificial Sequence
  Description of Artificial Sequence: Synthetic oligonucleotide for constructing gRNA expression plasmid
acaccggtggtgcagatgaagtacag

SEQ ID NO: 197 - DNA, 26 bp, Artificial Sequence
  Description of Artificial Sequence: Synthetic oligonucleotide for constructing gRNA expression plasmid
acaccggtggtgcagatgtactacag

SEQ ID NO: 198 - DNA, 26 bp, Artificial Sequence
  Description of Artificial Sequence: Synthetic oligonucleotide for constructing gRNA expression plasmid
acaccggtggtgcagaagaactacag

SEQ ID NO: 199 - DNA, 26 bp, Artificial Sequence
  Description of Artificial Sequence: Synthetic oligonucleotide for constructing gRNA expression plasmid
acaccggtggtgcacatgaactacag

SEQ ID NO: 200 - DNA, 26 bp, Artificial Sequence
  Description of Artificial Sequence: Synthetic oligonucleotide for constructing gRNA expression plasmid
acaccggtggtggagatgaactacag

SEQ ID NO: 201 - DNA, 26 bp, Artificial Sequence
  Description of Artificial Sequence: Synthetic oligonucleotide for constructing gRNA expression plasmid
acaccggtggagcagatgaactacag

SEQ ID NO: 202 - DNA, 26 bp, Artificial Sequence
  Description of Artificial Sequence: Synthetic oligonucleotide for constructing gRNA expression plasmid
acaccggtcgtgcagatgaactacag

SEQ ID NO: 203 - DNA, 26 bp, Artificial Sequence
  Description of Artificial Sequence: Synthetic oligonucleotide for constructing gRNA expression plasmid
acaccgctggtgcagatgaactacag

SEQ ID NO: 204 - DNA, 26 bp, Artificial Sequence
  Description of Artificial Sequence: Synthetic oligonucleotide for constructing gRNA expression plasmid
acaccggtggtgcacatgaacttctg

SEQ ID NO: 205 - DNA, 26 bp, Artificial Sequence
  Description of Artificial Sequence: Synthetic oligonucleotide for constructing gRNA expression plasmid
acaccggtggtgcacatgaagttcag

SEQ ID NO: 206 - DNA, 26 bp, Artificial Sequence
  Description of Artificial Sequence: Synthetic oligonucleotide for constructing gRNA expression plasmid
acaccggtggtgcacatgtacttcag

SEQ ID NO: 207 - DNA, 26 bp, Artificial Sequence
  Description of Artificial Sequence: Synthetic oligonucleotide for constructing gRNA expression plasmid
acaccggtggtgcacaagaacttcag

SEQ ID NO: 208 - DNA, 26 bp, Artificial Sequence
  Description of Artificial Sequence: Synthetic oligonucleotide for constructing gRNA expression plasmid
acaccggtggtggacatgaacttcag

SEQ ID NO: 209 - DNA, 26 bp, Artificial Sequence
  Description of Artificial Sequence: Synthetic oligonucleotide for constructing gRNA expression plasmid
acaccggtggagcacatgaacttcag

SEQ ID NO: 210 - DNA, 26 bp, Artificial Sequence
  Description of Artificial Sequence: Synthetic oligonucleotide for constructing gRNA expression plasmid
acaccggtcgtgcacatgaacttcag

SEQ ID NO: 211 - DNA, 26 bp, Artificial Sequence
  Description of Artificial Sequence: Synthetic oligonucleotide for constructing gRNA expression plasmid
acaccgctggtgcacatgaacttcag

SEQ ID NO: 212 - DNA, 26 bp, Artificial Sequence
  Description of Artificial Sequence: Synthetic oligonucleotide for constructing gRNA expression plasmid
acaccgctggtgcagatgaacttctg

SEQ ID NO: 213 - DNA, 26 bp, Artificial Sequence
  Description of Artificial Sequence: Synthetic oligonucleotide for constructing gRNA expression plasmid
acaccgctggtgcagatgaagttcag

SEQ ID NO: 214 - DNA, 26 bp, Artificial Sequence
  Description of Artificial Sequence: Synthetic oligonucleotide for constructing gRNA expression plasmid
acaccgctggtgcagatgtacttcag

SEQ ID NO: 215 - DNA, 26 bp, Artificial Sequence
  Description of Artificial Sequence: Synthetic oligonucleotide for constructing gRNA expression plasmid
acaccgctggtgcagaagaacttcag

SEQ ID NO: 216 - DNA, 26 bp, Artificial Sequence
  Description of Artificial Sequence: Synthetic oligonucleotide for constructing gRNA expression plasmid
acaccgctggtggagatgaacttcag

SEQ ID NO: 217 - DNA, 26 bp, Artificial Sequence
  Description of Artificial Sequence: Synthetic oligonucleotide for constructing gRNA expression plasmid
acaccgctggagcagatgaacttcag

SEQ ID NO: 218 - DNA, 26 bp, Artificial Sequence
  Description of Artificial Sequence: Synthetic oligonucleotide for constructing gRNA expression plasmid
acaccgctcgtgcagatgaacttcag

SEQ ID NO: 219 - DNA, 26 bp, Artificial Sequence
  Description of Artificial Sequence: Synthetic oligonucleotide for constructing gRNA expression plasmid
acaccgggtggggggagtttgctccg

SEQ ID NO: 220 - skipped

SEQ ID NO: 221 - DNA, 26 bp, Artificial Sequence
  Description of Artificial Sequence: Synthetic oligonucleotide for constructing gRNA expression plasmid
acaccgaccccctccaccccgcctcg

SEQ ID NO: 222 - skipped

SEQ ID NO: 223 - DNA, 26 bp, Artificial Sequence
  Description of Artificial Sequence: Synthetic oligonucleotide for constructing gRNA expression plasmid
acaccggtgagtgagtgtgtgcgtgg

SEQ ID NO: 224 - skipped

SEQ ID NO: 225 - DNA, 26 bp, Artificial Sequence
  Description of Artificial Sequence: Synthetic oligonucleotide for constructing gRNA expression plasmid
acaccgagtccgagcagaagaagaag

SEQ ID NO: 226 - skipped

SEQ ID NO: 227 - DNA, 26 bp, Artificial Sequence
  Description of Artificial Sequence: Synthetic oligonucleotide for constructing gRNA expression plasmid
acaccgtcatcttagtcattacctgg

SEQ ID NO: 228 - skipped

SEQ ID NO: 229 - DNA, 26 bp, Artificial Sequence
  Description of Artificial Sequence: Synthetic oligonucleotide for constructing gRNA expression plasmid
acaccggaatcccttctgcagcaccg

SEQ ID NO: 230 - DNA, 26 bp, Artificial Sequence
  Description of Artificial Sequence: Synthetic oligonucleotide for constructing gRNA expression plasmid
aaaacccggcaagctgcccgtgcccg

SEQ ID NO: 231 - DNA, 26 bp, Artificial Sequence
  Description of Artificial Sequence: Synthetic oligonucleotide for constructing gRNA expression plasmid
aaaacgcggcaagctgcccgtgcccg

SEQ ID NO: 232 - DNA, 26 bp, Artificial Sequence
  Description of Artificial Sequence: Synthetic oligonucleotide for constructing gRNA expression plasmid
aaaaccgggcaagctgcccgtgcccg

SEQ ID NO: 233 - DNA, 26 bp, Artificial Sequence
  Description of Artificial Sequence: Synthetic oligonucleotide for constructing gRNA expression plasmid
aaaaccccgcaagctgcccgtgcccg

SEQ ID NO: 234 - DNA, 26 bp, Artificial Sequence
  Description of Artificial Sequence: Synthetic oligonucleotide for constructing gRNA expression plasmid
aaaacccgccaagctgcccgtgcccg

SEQ ID NO: 235 - DNA, 26 bp, Artificial Sequence
  Description of Artificial Sequence: Synthetic oligonucleotide for constructing gRNA expression plasmid
aaaacccgggaagctgcccgtgcccg

SEQ ID NO: 236 - DNA, 26 bp, Artificial Sequence
  Description of Artificial Sequence: Synthetic oligonucleotide for constructing gRNA expression plasmid
aaaacccggctagctgcccgtgcccg

SEQ ID NO: 237 - DNA, 26 bp, Artificial Sequence
  Description of Artificial Sequence: Synthetic oligonucleotide for constructing gRNA expression plasmid
aaaacccggcatgctgcccgtgcccg

SEQ ID NO: 238 - DNA, 26 bp, Artificial Sequence
  Description of Artificial Sequence: Synthetic oligonucleotide for constructing gRNA expression plasmid
aaaacccggcaacctgcccgtgcccg

SEQ ID NO: 239 - DNA, 26 bp, Artificial Sequence
  Description of Artificial Sequence: Synthetic oligonucleotide for constructing gRNA expression plasmid
aaaacccggcaaggtgcccgtgcccg

SEQ ID NO: 240 - DNA, 26 bp, Artificial Sequence
  Description of Artificial Sequence: Synthetic oligonucleotide for constructing gRNA expression plasmid
aaaacccggcaagcagcccgtgcccg

SEQ ID NO: 241 - DNA, 26 bp, Artificial Sequence
  Description of Artificial Sequence: Synthetic oligonucleotide for constructing gRNA expression plasmid
aaaacccggcaagctccccgtgcccg

SEQ ID NO: 242 - DNA, 26 bp, Artificial Sequence
  Description of Artificial Sequence: Synthetic oligonucleotide for constructing gRNA expression plasmid
aaaacccggcaagctggccgtgcccg

SEQ ID NO: 243 - DNA, 26 bp, Artificial Sequence
  Description of Artificial Sequence: Synthetic oligonucleotide for constructing gRNA expression plasmid
aaaacccggcaagctgcgcgtgcccg

SEQ ID NO: 244 - DNA, 26 bp, Artificial Sequence
  Description of Artificial Sequence: Synthetic oligonucleotide for constructing gRNA expression plasmid
aaaacccggcaagctgccggtgcccg

SEQ ID NO: 245 - DNA, 26 bp, Artificial Sequence
  Description of Artificial Sequence: Synthetic oligonucleotide for constructing gRNA expression plasmid
aaaacccggcaagctgcccctgcccg

SEQ ID NO: 246 - DNA, 26 bp, Artificial Sequence
  Description of Artificial Sequence: Synthetic oligonucleotide for constructing gRNA expression plasmid
aaaacccggcaagctgcccgagcccg

SEQ ID NO: 247 - DNA, 26 bp, Artificial Sequence
  Description of Artificial Sequence: Synthetic oligonucleotide for constructing gRNA expression plasmid
aaaacccggcaagctgcccgtccccg

SEQ ID NO: 248 - DNA, 26 bp, Artificial Sequence
  Description of Artificial Sequence: Synthetic oligonucleotide for constructing gRNA expression plasmid
aaaacccggcaagctgcccgtggccg

SEQ ID NO: 249 - DNA, 26 bp, Artificial Sequence
  Description of Artificial Sequence: Synthetic oligonucleotide for constructing gRNA expression plasmid
aaaacccggcaagctgcccgtgcgcg

SEQ ID NO: 250 - DNA, 26 bp, Artificial Sequence
  Description of Artificial Sequence: Synthetic oligonucleotide for constructing gRNA expression plasmid
aaaacggggcaagctgcccgtgcccg

SEQ ID NO: 251 - DNA, 26 bp, Artificial Sequence
  Description of Artificial Sequence: Synthetic oligonucleotide for constructing gRNA expression plasmid
aaaaccccccaagctgcccgtgcccg

SEQ ID NO: 252 - DNA, 26 bp, Artificial Sequence
  Description of Artificial Sequence: Synthetic oligonucleotide for constructing gRNA expression plasmid
aaaacccgggtagctgcccgtgcccg

SEQ ID NO: 253 - DNA, 26 bp, Artificial Sequence
  Description of Artificial Sequence: Synthetic oligonucleotide for constructing gRNA expression plasmid
aaaacccggcatcctgcccgtgcccg

SEQ ID NO: 254 - DNA, 26 bp, Artificial Sequence
  Description of Artificial Sequence: Synthetic oligonucleotide for constructing gRNA expression plasmid
aaaacccggcaaggagcccgtgcccg

SEQ ID NO: 255 - DNA, 26 bp, Artificial Sequence
  Description of Artificial Sequence: Synthetic oligonucleotide for constructing gRNA expression plasmid
aaaacccggcaagctcgccgtgcccg

SEQ ID NO: 256 - DNA, 26 bp, Artificial Sequence
  Description of Artificial Sequence: Synthetic oligonucleotide for constructing gRNA expression plasmid
aaaacccggcaagctgcgggtgcccg

SEQ ID NO: 257 - DNA, 26 bp, Artificial Sequence
  Description of Artificial Sequence: Synthetic oligonucleotide for constructing gRNA expression plasmid
aaaacccggcaagctgccccagcccg

SEQ ID NO: 258 - DNA, 26 bp, Artificial Sequence
  Description of Artificial Sequence: Synthetic oligonucleotide for constructing gRNA expression plasmid
aaaacccggcaagctgcccgtcgccg

SEQ ID NO: 259 - DNA, 26 bp, Artificial Sequence
  Description of Artificial Sequence: Synthetic oligonucleotide for constructing gRNA expression plasmid
aaaacccggcaagctgcccgtgcggg

SEQ ID NO: 260 - DNA, 26 bp, Artificial Sequence
  Description of Artificial Sequence: Synthetic oligonucleotide for constructing gRNA expression plasmid
aaaacccggcaagctgcccgtgcccg

SEQ ID NO: 261 - DNA, 26 bp, Artificial Sequence
  Description of Artificial Sequence: Synthetic oligonucleotide for constructing gRNA expression plasmid
aaaacccggcaagctgcccgtgcccg

SEQ ID NO: 262 - DNA, 26 bp, Artificial Sequence
  Description of Artificial Sequence: Synthetic oligonucleotide for constructing gRNA expression plasmid
aaaacccggcaagctgcccgtgcccg

SEQ ID NO: 263 - DNA, 26 bp, Artificial Sequence
  Description of Artificial Sequence: Synthetic oligonucleotide for constructing gRNA expression plasmid
aaaacccggcaagctgcccgtgcccg

SEQ ID NO: 264 - DNA, 26 bp, Artificial Sequence
  Description of Artificial Sequence: Synthetic oligonucleotide for constructing gRNA expression plasmid
aaaacccggcaagctgcccgtgcccg

SEQ ID NO: 265 - DNA, 26 bp, Artificial Sequence
  Description of Artificial Sequence: Synthetic oligonucleotide for constructing gRNA expression plasmid
aaaacccggcaagctgcccgtgcccg

SEQ ID NO: 266 - DNA, 26 bp, Artificial Sequence
  Description of Artificial Sequence: Synthetic oligonucleotide for constructing gRNA expression plasmid
aaaacccggcaagctgcccgtgcccg

SEQ ID NO: 267 - DNA, 26 bp, Artificial Sequence
  Description of Artificial Sequence: Synthetic oligonucleotide for constructing gRNA expression plasmid
aaaacgccgcaagctgcccgtgcccg

SEQ ID NO: 268 - DNA, 26 bp, Artificial Sequence
  Description of Artificial Sequence: Synthetic oligonucleotide for constructing gRNA expression plasmid
aaaaccccggaagctgcccgtgcccg

SEQ ID NO: 269 - DNA, 26 bp, Artificial Sequence
  Description of Artificial Sequence: Synthetic oligonucleotide for constructing gRNA expression plasmid
aaaaccccgcatgctgcccgtgcccg

SEQ ID NO: 270 - DNA, 26 bp, Artificial Sequence
  Description of Artificial Sequence: Synthetic oligonucleotide for constructing gRNA expression plasmid
aaaaccccgcaaggtgcccgtgcccg

SEQ ID NO: 271 - DNA, 26 bp, Artificial Sequence
  Description of Artificial Sequence: Synthetic oligonucleotide for constructing gRNA expression plasmid
aaaaccccgcaagctccccgtgcccg

SEQ ID NO: 272 - DNA, 26 bp, Artificial Sequence
  Description of Artificial Sequence: Synthetic oligonucleotide for constructing gRNA expression plasmid
aaaaccccgcaagctgcgcgtgcccg

SEQ ID NO: 273 - DNA, 26 bp, Artificial Sequence
  Description of Artificial Sequence: Synthetic oligonucleotide for constructing gRNA expression plasmid
aaaaccccgcaagctgcccctgcccg

SEQ ID NO: 274 - DNA, 26 bp, Artificial Sequence
  Description of Artificial Sequence: Synthetic oligonucleotide for constructing gRNA expression plasmid
aaaaccccgcaagctgcccgtccccg

SEQ ID NO: 275 - DNA, 26 bp, Artificial Sequence
  Description of Artificial Sequence: Synthetic oligonucleotide for constructing gRNA expression plasmid
aaaaccccgcaagctgcccgtgcgcg

SEQ ID NO: 276 - DNA, 26 bp, Artificial Sequence
  Description of Artificial Sequence: Synthetic oligonucleotide for constructing gRNA expression plasmid
aaaacgcggcaagctccccgtgcccg

SEQ ID NO: 277 - DNA, 26 bp, Artificial Sequence
  Description of Artificial Sequence: Synthetic oligonucleotide for constructing gRNA expression plasmid
aaaacccgggaagctccccgtgcccg

SEQ ID NO: 278 - DNA, 26 bp, Artificial Sequence
  Description of Artificial Sequence: Synthetic oligonucleotide for constructing gRNA expression plasmid
aaaacccggcatgctccccgtgcccg

SEQ ID NO: 279 - DNA, 26 bp, Artificial Sequence
  Description of Artificial Sequence: Synthetic oligonucleotide for constructing gRNA expression plasmid
aaaacccggcaaggtccccgtgcccg

SEQ ID NO: 280 - DNA, 26 bp, Artificial Sequence
  Description of Artificial Sequence: Synthetic oligonucleotide for constructing gRNA expression plasmid
aaaacccggcaagctccgcgtgcccg

SEQ ID NO: 281 - DNA, 26 bp, Artificial Sequence
  Description of Artificial Sequence: Synthetic oligonucleotide for constructing gRNA expression plasmid
aaaacccggcaagctccccctgcccg

SEQ ID NO: 282 - DNA, 26 bp, Artificial Sequence
  Description of Artificial Sequence: Synthetic oligonucleotide for constructing gRNA expression plasmid
aaaacccggcaagctccccgtccccg

SEQ ID NO: 283 - DNA, 26 bp, Artificial Sequence
  Description of Artificial Sequence: Synthetic oligonucleotide for constructing gRNA expression plasmid
aaaacccggcaagctccccgtgcgcg

SEQ ID NO: 284 - DNA, 26 bp, Artificial Sequence
  Description of Artificial Sequence: Synthetic oligonucleotide for constructing gRNA expression plasmid
aaaacgcggcaagctgcccgtgcgcg

SEQ ID NO: 285 - DNA, 26 bp, Artificial Sequence
  Description of Artificial Sequence: Synthetic oligonucleotide for constructing gRNA expression plasmid
aaaacccgggaagctgcccgtgcgcg

SEQ ID NO: 286 - DNA, 26 bp, Artificial Sequence
  Description of Artificial Sequence: Synthetic oligonucleotide for constructing gRNA expression plasmid
aaaacccggcatgctgcccgtgcgcg

SEQ ID NO: 287 - DNA, 26 bp, Artificial Sequence
  Description of Artificial Sequence: Synthetic oligonucleotide for constructing gRNA expression plasmid
aaaacccggcaaggtgcccgtgcgcg

SEQ ID NO: 288 - DNA, 26 bp, Artificial Sequence
  Description of Artificial Sequence: Synthetic oligonucleotide for constructing gRNA expression plasmid
aaaacccggcaagctgcgcgtgcgcg

SEQ ID NO: 289 - DNA, 26 bp, Artificial Sequence
  Description of Artificial Sequence: Synthetic oligonucleotide for constructing gRNA expression plasmid
aaaacccggcaagctgcccctgcgcg

SEQ ID NO: 290 - DNA, 26 bp, Artificial Sequence
  Description of Artificial Sequence: Synthetic oligonucleotide for constructing gRNA expression plasmid
aaaacccggcaagctgcccgtccgcg

SEQ ID NO: 291 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 292 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 293 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 294 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 295 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 296 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 297 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 298 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 299 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 300 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 301 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 302 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 303 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 304 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 305 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 306 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 307 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 308 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 309 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 310 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 311 - DNA, 26 bp, Artificial Sequence
  Description of Artificial Sequence: Synthetic oligonucleotide for constructing gRNA expression plasmid
aaaactgaagcagaagaacggcatcg

SEQ ID NO: 312 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 313 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 314 - DNA, 26 bp, Artificial Sequence
  Description of Artificial Sequence: Synthetic oligonucleotide for constructing gRNA expression plasmid
aaaacacaagctcaagaacggcatcg

SEQ ID NO: 315 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 316 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 317 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 318 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 319 - DNA, 26 bp, Artificial Sequence
  Description of Artificial Sequence: Synthetic oligonucleotide for constructing gRNA expression plasmid
aaaacacaagcagaagaacggcatcg

SEQ ID NO: 320 - DNA, 26 bp, Artificial Sequence
  Description of Artificial Sequence: Synthetic oligonucleotide for constructing gRNA expression plasmid
aaaacacaagcagaagaacggcaagg

SEQ ID NO: 321 - DNA, 26 bp, Artificial Sequence
  Description of Artificial Sequence: Synthetic oligonucleotide for constructing gRNA expression plasmid
aaaacacaagcagaagaacgggtacg

SEQ ID NO: 322 - DNA, 26 bp, Artificial Sequence
  Description of Artificial Sequence: Synthetic oligonucleotide for constructing gRNA expression plasmid
aaaacacaagcagaagaacgcgtacg

SEQ ID NO: 323 - DNA, 26 bp, Artificial Sequence
  Description of Artificial Sequence: Synthetic oligonucleotide for constructing gRNA expression plasmid
aaaacacaagcagaagaacccgtacg

SEQ ID NO: 324 - DNA, 26 bp, Artificial Sequence
  Description of Artificial Sequence: Synthetic oligonucleotide for constructing gRNA expression plasmid
aaaacacaagcagaagaagccgtacg

SEQ ID NO: 325 - DNA, 26 bp, Artificial Sequence
  Description of Artificial Sequence: Synthetic oligonucleotide for constructing gRNA expression plasmid
aaaacacaagcagaagatgccgtacg

SEQ ID NO: 326 - DNA, 26 bp, Artificial Sequence
  Description of Artificial Sequence: Synthetic oligonucleotide for constructing gRNA expression plasmid
aaaacacaagcagaagttgccgtacg

SEQ ID NO: 327 - DNA, 26 bp, Artificial Sequence
  Description of Artificial Sequence: Synthetic oligonucleotide for constructing gRNA expression plasmid
aaaacacaagcagaacttgccgtacg

SEQ ID NO: 328 - DNA, 26 bp, Artificial Sequence
  Description of Artificial Sequence: Synthetic oligonucleotide for constructing gRNA expression plasmid
aaaactctagcagaagaacggcatcg

SEQ ID NO: 329 - DNA, 26 bp, Artificial Sequence
  Description of Artificial Sequence: Synthetic oligonucleotide for constructing gRNA expression plasmid
aaaacactaccagaagaacggcatcg

SEQ ID NO: 330 - DNA, 26 bp, Artificial Sequence
  Description of Artificial Sequence: Synthetic oligonucleotide for constructing gRNA expression plasmid
aaaacactagctgaagaacggcatcg

SEQ ID NO: 331 - DNA, 26 bp, Artificial Sequence
  Description of Artificial Sequence: Synthetic oligonucleotide for constructing gRNA expression plasmid
aaaacactagcagtagaacggcatcg

SEQ ID NO: 332 - DNA, 26 bp, Artificial Sequence
  Description of Artificial Sequence: Synthetic oligonucleotide for constructing gRNA expression plasmid
aaaacactagcagaacaacggcatcg

SEQ ID NO: 333 - DNA, 26 bp, Artificial Sequence
  Description of Artificial Sequence: Synthetic oligonucleotide for constructing gRNA expression plasmid
aaaacactagcagaagatcggcatcg

SEQ ID NO: 334 - DNA, 26 bp, Artificial Sequence
  Description of Artificial Sequence: Synthetic oligonucleotide for constructing gRNA expression plasmid
aaaacactagcagaagaaccgcatcg

SEQ ID NO: 335 - DNA, 26 bp, Artificial Sequence
  Description of Artificial Sequence: Synthetic oligonucleotide for constructing gRNA expression plasmid
aaaacactagcagaagaacgggatcg

SEQ ID NO: 336 - DNA, 26 bp, Artificial Sequence
  Description of Artificial Sequence: Synthetic oligonucleotide for constructing gRNA expression plasmid
aaaacactagcagaagaacggcaacg

SEQ ID NO: 337 - DNA, 26 bp, Artificial Sequence
  Description of Artificial Sequence: Synthetic oligonucleotide for constructing gRNA expression plasmid
aaaactcaagcagaacaacggcatcg

SEQ ID NO: 338 - DNA, 26 bp, Artificial Sequence
  Description of Artificial Sequence: Synthetic oligonucleotide for constructing gRNA expression plasmid
aaaacacaaccagaacaacggcatcg

SEQ ID NO: 339 - DNA, 26 bp, Artificial Sequence
  Description of Artificial Sequence: Synthetic oligonucleotide for constructing gRNA expression plasmid
aaaacacaagctgaacaacggcatcg

SEQ ID NO: 340 - DNA, 26 bp, Artificial Sequence
  Description of Artificial Sequence: Synthetic oligonucleotide for constructing gRNA expression plasmid
aaaacacaagcagtacaacggcatcg

SEQ ID NO: 341 - DNA, 26 bp, Artificial Sequence
  Description of Artificial Sequence: Synthetic oligonucleotide for constructing gRNA expression plasmid
aaaacacaagcagaacatcggcatcg

SEQ ID NO: 342 - DNA, 26 bp, Artificial Sequence
  Description of Artificial Sequence: Synthetic oligonucleotide for constructing gRNA expression plasmid
aaaacacaagcagaacaaccgcatcg

SEQ ID NO: 343 - DNA, 26 bp, Artificial Sequence
  Description of Artificial Sequence: Synthetic oligonucleotide for constructing gRNA expression plasmid
aaaacacaagcagaacaacgggatcg

SEQ ID NO: 344 - DNA, 26 bp, Artificial Sequence
  Description of Artificial Sequence: Synthetic oligonucleotide for constructing gRNA expression plasmid
aaaacacaagcagaacaacggcaacg

SEQ ID NO: 345 - DNA, 26 bp, Artificial Sequence
  Description of Artificial Sequence: Synthetic oligonucleotide for constructing gRNA expression plasmid
aaaactcaagcagaagaacggcaacg

SEQ ID NO: 346 - DNA, 26 bp, Artificial Sequence
  Description of Artificial Sequence: Synthetic oligonucleotide for constructing gRNA expression plasmid
aaaacacaaccagaagaacggcaacg

SEQ ID NO: 347 - DNA, 26 bp, Artificial Sequence
  Description of Artificial Sequence: Synthetic oligonucleotide for constructing gRNA expression plasmid
aaaacacaagctgaagaacggcaacg

SEQ ID NO: 348 - DNA, 26 bp, Artificial Sequence
  Description of Artificial Sequence: Synthetic oligonucleotide for constructing gRNA expression plasmid
aaaacacaagcagtagaacggcaacg

SEQ ID NO: 349 - DNA, 26 bp, Artificial Sequence
  Description of Artificial Sequence: Synthetic oligonucleotide for constructing gRNA expression plasmid
aaaacacaagcagaagatcggcaacg

SEQ ID NO: 350 - DNA, 26 bp, Artificial Sequence
  Description of Artificial Sequence: Synthetic oligonucleotide for constructing gRNA expression plasmid
aaaacacaagcagaagaaccgcaacg

SEQ ID NO: 351 - DNA, 26 bp, Artificial Sequence
  Description of Artificial Sequence: Synthetic oligonucleotide for constructing gRNA expression plasmid
aaaacacaagcagaagaacgggaacg

SEQ ID NO: 352 - DNA, 26 bp, Artificial Sequence
  Description of Artificial Sequence: Synthetic oligonucleotide for constructing gRNA expression plasmid
aaaactgaagttcatctgcaccaccg

SEQ ID NO: 353 - DNA, 26 bp, Artificial Sequence
  Description of Artificial Sequence: Synthetic oligonucleotide for constructing gRNA expression plasmid
aaaacagaagttcatctgcaccaccg

SEQ ID NO: 354 - DNA, 26 bp, Artificial Sequence
  Description of Artificial Sequence: Synthetic oligonucleotide for constructing gRNA expression plasmid
aaaactcaagttcatctgcaccaccg

SEQ ID NO: 355 - DNA, 26 bp, Artificial Sequence
  Description of Artificial Sequence: Synthetic oligonucleotide for constructing gRNA expression plasmid
aaaactgtagttcatctgcaccaccg

SEQ ID NO: 356 - DNA, 26 bp, Artificial Sequence
  Description of Artificial Sequence: Synthetic oligonucleotide for constructing gRNA expression plasmid
aaaactgatgttcatctgcaccaccg

SEQ ID NO: 357 - DNA, 26 bp, Artificial Sequence
  Description of Artificial Sequence: Synthetic oligonucleotide for constructing gRNA expression plasmid
aaaactgaacttcatctgcaccaccg

SEQ ID NO: 358 - DNA, 26 bp, Artificial Sequence
  Description of Artificial Sequence: Synthetic oligonucleotide for constructing gRNA expression plasmid
aaaactgaagatcatctgcaccaccg

SEQ ID NO: 359 - DNA, 26 bp, Artificial Sequence
  Description of Artificial Sequence: Synthetic oligonucleotide for constructing gRNA expression plasmid
aaaactgaagtacatctgcaccaccg

SEQ ID NO: 360 - DNA, 26 bp, Artificial Sequence
  Description of Artificial Sequence: Synthetic oligonucleotide for constructing gRNA expression plasmid
aaaactgaagttgatctgcaccaccg

SEQ ID NO: 361 - DNA, 26 bp, Artificial Sequence
  Description of Artificial Sequence: Synthetic oligonucleotide for constructing gRNA expression plasmid
aaaactgaagttcttctgcaccaccg

SEQ ID NO: 362 - DNA, 26 bp, Artificial Sequence
  Description of Artificial Sequence: Synthetic oligonucleotide for constructing gRNA expression plasmid
aaaactgaagttcaactgcaccaccg

SEQ ID NO: 363 - DNA, 26 bp, Artificial Sequence
  Description of Artificial Sequence: Synthetic oligonucleotide for constructing gRNA expression plasmid
aaaactgaagttcatgtgcaccaccg

SEQ ID NO: 364 - DNA, 26 bp, Artificial Sequence
  Description of Artificial Sequence: Synthetic oligonucleotide for constructing gRNA expression plasmid
aaaactgaagttcatcagcaccaccg

SEQ ID NO: 365 - DNA, 26 bp, Artificial Sequence
  Description of Artificial Sequence: Synthetic oligonucleotide for constructing gRNA expression plasmid
aaaactgaagttcatctccaccaccg

SEQ ID NO: 366 - DNA, 26 bp, Artificial Sequence
  Description of Artificial Sequence: Synthetic oligonucleotide for constructing gRNA expression plasmid
aaaactgaagttcatctggaccaccg

SEQ ID NO: 367 - DNA, 26 bp, Artificial Sequence
  Description of Artificial Sequence: Synthetic oligonucleotide for constructing gRNA expression plasmid
aaaactgaagttcatctgctccaccg

SEQ ID NO: 368 - DNA, 26 bp, Artificial Sequence
  Description of Artificial Sequence: Synthetic oligonucleotide for constructing gRNA expression plasmid
aaaactgaagttcatctgcagcaccg

SEQ ID NO: 369 - DNA, 26 bp, Artificial Sequence
  Description of Artificial Sequence: Synthetic oligonucleotide for constructing gRNA expression plasmid
aaaactgaagttcatctgcacgaccg

SEQ ID NO: 370 - DNA, 26 bp, Artificial Sequence
  Description of Artificial Sequence: Synthetic oligonucleotide for constructing gRNA expression plasmid
aaaactgaagttcatctgcacctccg

SEQ ID NO: 371 - DNA, 26 bp, Artificial Sequence
  Description of Artificial Sequence: Synthetic oligonucleotide for constructing gRNA expression plasmid
aaaactgaagttcatctgcaccagcg

SEQ ID NO: 372 - DNA, 26 bp, Artificial Sequence
  Description of Artificial Sequence: Synthetic oligonucleotide for constructing gRNA expression plasmid
aaaacacaagttcatctgcaccaccg

SEQ ID NO: 373 - DNA, 26 bp, Artificial Sequence
  Description of Artificial Sequence: Synthetic oligonucleotide for constructing gRNA expression plasmid
aaaactgttgttcatctgcaccaccg

SEQ ID NO: 374 - DNA, 26 bp, Artificial Sequence
  Description of Artificial Sequence: Synthetic oligonucleotide for constructing gRNA expression plasmid
aaaactgaacatcatctgcaccaccg

SEQ ID NO: 375 - DNA, 26 bp, Artificial Sequence
  Description of Artificial Sequence: Synthetic oligonucleotide for constructing gRNA expression plasmid
aaaactgaagtagatctgcaccaccg

SEQ ID NO: 376 - DNA, 26 bp, Artificial Sequence
  Description of Artificial Sequence: Synthetic oligonucleotide for constructing gRNA expression plasmid
aaaactgaagttctactgcaccaccg

SEQ ID NO: 377 - DNA, 26 bp, Artificial Sequence
  Description of Artificial Sequence: Synthetic oligonucleotide for constructing gRNA expression plasmid
aaaactgaagttcatgagcaccaccg

SEQ ID NO: 378 - DNA, 26 bp, Artificial Sequence
  Description of Artificial Sequence: Synthetic oligonucleotide for constructing gRNA expression plasmid
aaaactgaagttcatctcgaccaccg

SEQ ID NO: 379 - DNA, 26 bp, Artificial Sequence
  Description of Artificial Sequence: Synthetic oligonucleotide for constructing gRNA expression plasmid
aaaactgaagttcatctgctgcaccg

SEQ ID NO: 380 - DNA, 26 bp, Artificial Sequence
  Description of Artificial Sequence: Synthetic oligonucleotide for constructing gRNA expression plasmid
aaaactgaagttcatctgcacgtccg

SEQ ID NO: 381 - DNA, 26 bp, Artificial Sequence
  Description of Artificial Sequence: Synthetic oligonucleotide for constructing gRNA expression plasmid
aaaactgaagttcatctgcaccaggg

SEQ ID NO: 382 - DNA, 26 bp, Artificial Sequence
  Description of Artificial Sequence: Synthetic oligonucleotide for constructing gRNA expression plasmid
aaaactgaagttcatctgcacgtgcg

SEQ ID NO: 383 - DNA, 26 bp, Artificial Sequence
  Description of Artificial Sequence: Synthetic oligonucleotide for constructing gRNA expression plasmid
aaaactgaagttcatctgcaggtgcg

SEQ ID NO: 384 - DNA, 26 bp, Artificial Sequence
  Description of Artificial Sequence: Synthetic oligonucleotide for constructing gRNA expression plasmid
aaaactgaagttcatctgctggtgcg

SEQ ID NO: 385 - DNA, 26 bp, Artificial Sequence
  Description of Artificial Sequence: Synthetic oligonucleotide for constructing gRNA expression plasmid
aaaactgaagttcatctggtggtgcg

SEQ ID NO: 386 - DNA, 26 bp, Artificial Sequence
  Description of Artificial Sequence: Synthetic oligonucleotide for constructing gRNA expression plasmid
aaaactgaagttcatctcgtggtgcg

SEQ ID NO: 387 - DNA, 26 bp, Artificial Sequence
  Description of Artificial Sequence: Synthetic oligonucleotide for constructing gRNA expression plasmid
aaaactgaagttcatcacgtggtgcg

SEQ ID NO: 388 - DNA, 26 bp, Artificial Sequence
  Description of Artificial Sequence: Synthetic oligonucleotide for constructing gRNA expression plasmid
aaaactgaagttcatgacgtggtgcg

SEQ ID NO: 389 - DNA, 26 bp, Artificial Sequence
  Description of Artificial Sequence: Synthetic oligonucleotide for constructing gRNA expression plasmid
aaaacagtagttcatctgcaccaccg

SEQ ID NO: 390 - DNA, 26 bp, Artificial Sequence
  Description of Artificial Sequence: Synthetic oligonucleotide for constructing gRNA expression plasmid
aaaactgtacttcatctgcaccaccg

SEQ ID NO: 391 - DNA, 26 bp, Artificial Sequence
  Description of Artificial Sequence: Synthetic oligonucleotide for constructing gRNA expression plasmid
aaaactgtagtacatctgcaccaccg

SEQ ID NO: 392 - DNA, 26 bp, Artificial Sequence
  Description of Artificial Sequence: Synthetic oligonucleotide for constructing gRNA expression plasmid
aaaactgtagttcttctgcaccaccg

SEQ ID NO: 393 - DNA, 26 bp, Artificial Sequence
  Description of Artificial Sequence: Synthetic oligonucleotide for constructing gRNA expression plasmid
aaaactgtagttcatgtgcaccaccg

SEQ ID NO: 394 - DNA, 26 bp, Artificial Sequence
  Description of Artificial Sequence: Synthetic oligonucleotide for constructing gRNA expression plasmid
aaaactgtagttcatctccaccaccg

SEQ ID NO: 395 - DNA, 26 bp, Artificial Sequence
  Description of Artificial Sequence: Synthetic oligonucleotide for constructing gRNA expression plasmid
aaaactgtagttcatctgctccaccg

SEQ ID NO: 396 - DNA, 26 bp, Artificial Sequence
  Description of Artificial Sequence: Synthetic oligonucleotide for constructing gRNA expression plasmid
aaaactgtagttcatctgcacgaccg

SEQ ID NO: 397 - DNA, 26 bp, Artificial Sequence
  Description of Artificial Sequence: Synthetic oligonucleotide for constructing gRNA expression plasmid
aaaactgtagttcatctgcaccagcg

SEQ ID NO: 398 - DNA, 26 bp, Artificial Sequence
  Description of Artificial Sequence: Synthetic oligonucleotide for constructing gRNA expression plasmid
aaaacagaagttcatgtgcaccaccg

SEQ ID NO: 399 - DNA, 26 bp, Artificial Sequence
  Description of Artificial Sequence: Synthetic oligonucleotide for constructing gRNA expression plasmid
aaaactgaacttcatgtgcaccaccg

SEQ ID NO: 400 - DNA, 26 bp, Artificial Sequence
  Description of Artificial Sequence: Synthetic oligonucleotide for constructing gRNA expression plasmid
aaaactgaagtacatgtgcaccaccg

SEQ ID NO: 401 - DNA, 26 bp, Artificial Sequence
  Description of Artificial Sequence: Synthetic oligonucleotide for constructing gRNA expression plasmid
aaaactgaagttcttgtgcaccaccg

SEQ ID NO: 402 - DNA, 26 bp, Artificial Sequence
  Description of Artificial Sequence: Synthetic oligonucleotide for constructing gRNA expression plasmid
aaaactgaagttcatgtccaccaccg

SEQ ID NO: 403 - DNA, 26 bp, Artificial Sequence
  Description of Artificial Sequence: Synthetic oligonucleotide for constructing gRNA expression plasmid
aaaactgaagttcatgtgctccaccg

SEQ ID NO: 404 - DNA, 26 bp, Artificial Sequence
  Description of Artificial Sequence: Synthetic oligonucleotide for constructing gRNA expression plasmid
aaaactgaagttcatgtgcacgaccg

SEQ ID NO: 405 - DNA, 26 bp, Artificial Sequence
  Description of Artificial Sequence: Synthetic oligonucleotide for constructing gRNA expression plasmid
aaaactgaagttcatgtgcaccagcg

SEQ ID NO: 406 - DNA, 26 bp, Artificial Sequence
  Description of Artificial Sequence: Synthetic oligonucleotide for constructing gRNA expression plasmid
aaaacagaagttcatctgcaccagcg

SEQ ID NO: 407 - DNA, 26 bp, Artificial Sequence
  Description of Artificial Sequence: Synthetic oligonucleotide for constructing gRNA expression plasmid
aaaactgaacttcatctgcaccagcg

SEQ ID NO: 408 - DNA, 26 bp, Artificial Sequence
  Description of Artificial Sequence: Synthetic oligonucleotide for constructing gRNA expression plasmid
aaaactgaagtacatctgcaccagcg

SEQ ID NO: 409 - DNA, 26 bp, Artificial Sequence
  Description of Artificial Sequence: Synthetic oligonucleotide for constructing gRNA expression plasmid
aaaactgaagttcttctgcaccagcg

SEQ ID NO: 410 - DNA, 26 bp, Artificial Sequence
  Description of Artificial Sequence: Synthetic oligonucleotide for constructing gRNA expression plasmid
aaaactgaagttcatctccaccagcg

SEQ ID NO: 411 - DNA, 26 bp, Artificial Sequence
  Description of Artificial Sequence: Synthetic oligonucleotide for constructing gRNA expression plasmid
aaaactgaagttcatctgctccagcg

SEQ ID NO: 412 - DNA, 26 bp, Artificial Sequence
  Description of Artificial Sequence: Synthetic oligonucleotide for constructing gRNA expression plasmid
aaaactgaagttcatctgcacgagcg

SEQ ID NO: 413 - DNA, 26 bp, Artificial Sequence
  Description of Artificial Sequence: Synthetic oligonucleotide for constructing gRNA expression plasmid
aaaacggagcaaactccccccacccg

SEQ ID NO: 414 - skipped

SEQ ID NO: 415 - DNA, 26 bp, Artificial Sequence
  Description of Artificial Sequence: Synthetic oligonucleotide for constructing gRNA expression plasmid
aaaacgaggcggggtggagggggtcg

SEQ ID NO: 416 - skipped

SEQ ID NO: 417 - DNA, 26 bp, Artificial Sequence
  Description of Artificial Sequence: Synthetic oligonucleotide for constructing gRNA expression plasmid
aaaaccacgcacacactcactcaccg

SEQ ID NO: 418 - skipped

SEQ ID NO: 419 - DNA, 26 bp, Artificial Sequence
  Description of Artificial Sequence: Synthetic oligonucleotide for constructing gRNA expression plasmid
aaaacttcttcttctgctcggactcg

SEQ ID NO: 420 - skipped

SEQ ID NO: 421 - DNA, 26 bp, Artificial Sequence
  Description of Artificial Sequence: Synthetic oligonucleotide for constructing gRNA expression plasmid
aaaaccaggtaatgactaagatgacg

SEQ ID NO: 422 - skipped

SEQ ID NO: 423 - DNA, 26 bp, Artificial Sequence
  Description of Artificial Sequence: Synthetic oligonucleotide for constructing gRNA expression plasmid
aaaacggtgctgcagaagggattccg

SEQ ID NO: 424 - DNA, 23 bp, Artificial Sequence
  Description of Artificial Sequence: Synthetic target site sequence
gggtgattgaagtttgctscagg

SEQ ID NO: 425 - DNA, 23 bp, Artificial Sequence
  Description of Artificial Sequence: Synthetic target site sequence
ctctccccccaccccccctctgg

SEQ ID NO: 426 - DNA, 22 bp, Artificial Sequence
  Description of Artificial Sequence: Synthetic target site sequence
atttcctcccccccccctcagg

SEQ ID NO: 427 - DNA, 23 bp, Artificial Sequence
  Description of Artificial Sequence: Synthetic target site sequence
aagacagaggagaagaagaaggg

SEQ ID NO: 428 - DNA, 23 bp, Artificial Sequence
  Description of Artificial Sequence: Synthetic target site sequence
tcattgyagcagaagaagaaagg

SEQ ID NO: 429 - DNA, 23 bp, Artificial Sequence
  Description of Artificial Sequence: Synthetic target site sequence
ggtatctaagtcawtacctgtgg

SEQ ID NO: 430 - DNA, 46 bp, Artificial Sequence
  Description of Artificial Sequence: Synthetic target site sequence
tccatctcactcattacctgaggtccatctcactcattacctgatg

SEQ ID NO: 431 - DNA, 23 bp, Artificial Sequence
  Description of Artificial Sequence: Synthetic target site sequence
tttatattagtgattacctgcgg

SEQ ID NO: 432 - DNA, 23 bp, Artificial Sequence
  Description of Artificial Sequence: Synthetic target site sequence
ggaatcccctctccagccyctgg

SEQ ID NO: 433 - DNA, 23 bp, Artificial Sequence
  Description of Artificial Sequence: Synthetic target site sequence
ggaatctcttccttggcatctgg

SEQ ID NO: 434 - DNA, 23 bp, Artificial Sequence
  Description of Artificial Sequence: Synthetic target site sequence
cagattactgctgcagcaccggg

SEQ ID NO: 435 - DNA, 23 bp, Artificial Sequence
  Description of Artificial Sequence: Synthetic target site sequence
acacaaacttctgcagcacstgg

SEQ ID NO: 436 - DNA, 20 bp, Artificial Sequence
  Description of Artificial Sequence: Synthetic PCR primer
tccagatggcacattgtcag

SEQ ID NO: 437 - DNA, 20 bp, Artificial Sequence
  Description of Artificial Sequence: Synthetic PCR primer
ggggcccactcttcttccat

SEQ ID NO: 438 - DNA, 22 bp, Artificial Sequence
  Description of Artificial Sequence: Synthetic PCR primer
gctaagcagagatgcctatgcc

SEQ ID NO: 439 - DNA, 20 bp, Artificial Sequence
  Description of Artificial Sequence: Synthetic PCR primer
accccacagccaggttttca

SEQ ID NO: 440 - DNA, 20 bp, Artificial Sequence
  Description of Artificial Sequence: Synthetic PCR primer
tgcggcaacttcagacaacc

SEQ ID NO: 441 - DNA, 20 bp, Artificial Sequence
  Description of Artificial Sequence: Synthetic PCR primer
gcatgtcaggatctgacccc

SEQ ID NO: 442 - DNA, 20 bp, Artificial Sequence
  Description of Artificial Sequence: Synthetic PCR primer
ccaccacatgttctgggtgc

SEQ ID NO: 443 - DNA, 20 bp, Artificial Sequence
  Description of Artificial Sequence: Synthetic PCR primer
ggctctccctgccctagttt

SEQ ID NO: 444 - DNA, 24 bp, Artificial Sequence
  Description of Artificial Sequence: Synthetic PCR primer
ggggctgagaacacatgagatgca

SEQ ID NO: 445 - DNA, 20 bp, Artificial Sequence
  Description of Artificial Sequence: Synthetic PCR primer
cccgacctccgctccaaagc

SEQ ID NO: 446 - DNA, 20 bp, Artificial Sequence
  Description of Artificial Sequence: Synthetic PCR primer
tgcaaggtcgcatagtccca

SEQ ID NO: 447 - DNA, 21 bp, Artificial Sequence
  Description of Artificial Sequence: Synthetic PCR primer
gcccattctttttgcagtgga

SEQ ID NO: 448 - DNA, 20 bp, Artificial Sequence
  Description of Artificial Sequence: Synthetic PCR primer
gcccccagcccctctgtttc

SEQ ID NO: 449 - DNA, 20 bp, Artificial Sequence
  Description of Artificial Sequence: Synthetic PCR primer
cggctgccttccctgagtcc

SEQ ID NO: 450 - DNA, 26 bp, Artificial Sequence
  Description of Artificial Sequence: Synthetic PCR primer
tgaccctggagtacaaaatgttccca

SEQ ID NO: 451 - DNA, 20 bp, Artificial Sequence
  Description of Artificial Sequence: Synthetic PCR primer
tgcctccacccttagcccct

SEQ ID NO: 452 - DNA, 22 bp, Artificial Sequence
  Description of Artificial Sequence: Synthetic PCR primer
aactcaggacaacactgcctgt

SEQ ID NO: 453 - DNA, 20 bp, Artificial Sequence
  Description of Artificial Sequence: Synthetic PCR primer
tcctccttggagaggggccc

SEQ ID NO: 454 - DNA, 20 bp, Artificial Sequence
  Description of Artificial Sequence: Synthetic PCR primer
ccgagggcatgggcaatcct

SEQ ID NO: 455 - DNA, 23 bp, Artificial Sequence
  Description of Artificial Sequence: Synthetic PCR primer
tgctttgcatggggtctcagaca

SEQ ID NO: 456 - DNA, 27 bp, Artificial Sequence
  Description of Artificial Sequence: Synthetic PCR primer
agctccttctcatttctcttctgctgt

SEQ ID NO: 457 - DNA, 23 bp, Artificial Sequence
  Description of Artificial Sequence: Synthetic PCR primer
agcagacacaggtgaatgctgct

SEQ ID NO: 458 - DNA, 20 bp, Artificial Sequence
  Description of Artificial Sequence: Synthetic PCR primer
cctgtggggctctcaggtgc

SEQ ID NO: 459 - DNA, 20 bp, Artificial Sequence
  Description of Artificial Sequence: Synthetic PCR primer
agctgcactggggaatgagt

SEQ ID NO: 460 - DNA, 20 bp, Artificial Sequence
  Description of Artificial Sequence: Synthetic PCR primer
ccagcctgggcaacaaagcg

SEQ ID NO: 461 - DNA, 20 bp, Artificial Sequence
  Description of Artificial Sequence: Synthetic PCR primer
tacccccactgccccattgc

SEQ ID NO: 462 - DNA, 21 bp, Artificial Sequence
  Description of Artificial Sequence: Synthetic PCR primer
acggattcacgacggaggtgc

SEQ ID NO: 463 - DNA, 23 bp, Artificial Sequence
  Description of Artificial Sequence: Synthetic PCR primer
tgtggttgaagtaggggacaggt

SEQ ID NO: 464 - DNA, 23 bp, Artificial Sequence
  Description of Artificial Sequence: Synthetic PCR primer
tgggatggcagagtcatcaacgt

SEQ ID NO: 465 - DNA, 20 bp, Artificial Sequence
  Description of Artificial Sequence: Synthetic PCR primer
atggggcgctccagtctgtg

SEQ ID NO: 466 - DNA, 20 bp, Artificial Sequence
  Description of Artificial Sequence: Synthetic PCR primer
ggggagggaggaccagggaa

SEQ ID NO: 467 - DNA, 20 bp, Artificial Sequence
  Description of Artificial Sequence: Synthetic PCR primer
atcccgtgcaggaagtcgcc

SEQ ID NO: 468 - DNA, 20 bp, Artificial Sequence
  Description of Artificial Sequence: Synthetic PCR primer
ccccaaccctttgctcagcg

SEQ ID NO: 469 - DNA, 20 bp, Artificial Sequence
  Description of Artificial Sequence: Synthetic PCR primer
atcgacgaggagggggcctt

SEQ ID NO: 470 - DNA, 20 bp, Artificial Sequence
  Description of Artificial Sequence: Synthetic PCR primer
tgctcaaggggcctgttcca

SEQ ID NO: 471 - DNA, 20 bp, Artificial Sequence
  Description of Artificial Sequence: Synthetic PCR primer
tgcctggcacgcagtaggtg

SEQ ID NO: 472 - DNA, 20 bp, Artificial Sequence
  Description of Artificial Sequence: Synthetic PCR primer
acctgggcttgccactaggg

SEQ ID NO: 473 - DNA, 20 bp, Artificial Sequence
  Description of Artificial Sequence: Synthetic PCR primer
gtggccgggctactgctacc

SEQ ID NO: 474 - DNA, 20 bp, Artificial Sequence
  Description of Artificial Sequence: Synthetic PCR primer
gcaagaggcggaggagaccc

SEQ ID NO: 475 - DNA, 23 bp, Artificial Sequence
  Description of Artificial Sequence: Synthetic PCR primer
ggggtcagtggtgatatccccct

SEQ ID NO: 476 - DNA, 20 bp, Artificial Sequence
  Description of Artificial Sequence: Synthetic PCR primer
agagaggccacgtggagggt

SEQ ID NO: 477 - DNA, 20 bp, Artificial Sequence
  Description of Artificial Sequence: Synthetic PCR primer
gacagtgccttgcgatgcac

SEQ ID NO: 478 - DNA, 20 bp, Artificial Sequence
  Description of Artificial Sequence: Synthetic PCR primer
tgtgtgaacgcagcctggct

SEQ ID NO: 479 - DNA, 22 bp, Artificial Sequence
  Description of Artificial Sequence: Synthetic PCR primer
ggttctcccttggctcctgtga

SEQ ID NO: 480 - DNA, 27 bp, Artificial Sequence
  Description of Artificial Sequence: Synthetic PCR primer
tgaagtcaacaatctaagcttccacct

SEQ ID NO: 481 - DNA, 24 bp, Artificial Sequence
  Description of Artificial Sequence: Synthetic PCR primer
tgattgggctgcagttcatgtaca

SEQ ID NO: 482 - DNA, 21 bp, Artificial Sequence
  Description of Artificial Sequence: Synthetic PCR primer
tccatgggcccctctgaaaga

SEQ ID NO: 483 - DNA, 20 bp, Artificial Sequence
  Description of Artificial Sequence: Synthetic PCR primer
gcggttggtggggttgatgc

SEQ ID NO: 484 - DNA, 25 bp, Artificial Sequence
  Description of Artificial Sequence: Synthetic PCR primer
aggcaagattttccagtgtgcaaga

SEQ ID NO: 485 - DNA, 20 bp, Artificial Sequence
  Description of Artificial Sequence: Synthetic PCR primer
gctgctggtcgggctctctg

SEQ ID NO: 486 - DNA, 20 bp, Artificial Sequence
  Description of Artificial Sequence: Synthetic PCR primer
gctgcgaggcttccgtgaga

SEQ ID NO: 487 - DNA, 20 bp, Artificial Sequence
  Description of Artificial Sequence: Synthetic PCR primer
ccaggagcctgagagctgcc

SEQ ID NO: 488 - DNA, 20 bp, Artificial Sequence
  Description of Artificial Sequence: Synthetic PCR primer
ctgtgctcagcctgggtgct

SEQ ID NO: 489 - DNA, 20 bp, Artificial Sequence
  Description of Artificial Sequence: Synthetic PCR primer
agctcgcgccagatctgtgg

SEQ ID NO: 490 - DNA, 22 bp, Artificial Sequence
  Description of Artificial Sequence: Synthetic PCR primer
agagaagtcgaggaagagagag

SEQ ID NO: 491 - DNA, 22 bp, Artificial Sequence
  Description of Artificial Sequence: Synthetic PCR primer
tggacagctgcagtactccctg

SEQ ID NO: 492 - DNA, 20 bp, Artificial Sequence
  Description of Artificial Sequence: Synthetic PCR primer
caagatgtgcacttgggcta

SEQ ID NO: 493 - DNA, 20 bp, Artificial Sequence
  Description of Artificial Sequence: Synthetic PCR primer
gtccagtgcctgaccctggc

SEQ ID NO: 494 - DNA, 20 bp, Artificial Sequence
  Description of Artificial Sequence: Synthetic PCR primer
gctcccgatcctctgccacc

SEQ ID NO: 495 - DNA, 20 bp, Artificial Sequence
  Description of Artificial Sequence: Synthetic PCR primer
ggggacaggcaggcaaggag

SEQ ID NO: 496 - DNA, 20 bp, Artificial Sequence
  Description of Artificial Sequence: Synthetic PCR primer
aaggggctgctgggtaggac

SEQ ID NO: 497 - DNA, 20 bp, Artificial Sequence
  Description of Artificial Sequence: Synthetic PCR primer
gaccctcaggaagctgggag

SEQ ID NO: 498 - DNA, 18 bp, Artificial Sequence
  Description of Artificial Sequence: Synthetic PCR primer
ccgcggcgctctgctaga

SEQ ID NO: 499 - DNA, 20 bp, Artificial Sequence
  Description of Artificial Sequence: Synthetic PCR primer
ccaggtggtgtcagcggagg

SEQ ID NO: 500 - DNA, 20 bp, Artificial Sequence
  Description of Artificial Sequence: Synthetic PCR primer
cgactccacggcgtctcagg

SEQ ID NO: 501 - DNA, 20 bp, Artificial Sequence
  Description of Artificial Sequence: Synthetic PCR primer
cttccctcccccagcaccac

SEQ ID NO: 502 - DNA, 20 bp, Artificial Sequence
  Description of Artificial Sequence: Synthetic PCR primer
ccccggggagtctgtcctga

SEQ ID NO: 503 - DNA, 20 bp, Artificial Sequence
  Description of Artificial Sequence: Synthetic PCR primer
gaagcgcgaaaacccggctc

SEQ ID NO: 504 - DNA, 20 bp, Artificial Sequence
  Description of Artificial Sequence: Synthetic PCR primer
agggtggtcagggaggcctt

SEQ ID NO: 505 - DNA, 20 bp, Artificial Sequence
  Description of Artificial Sequence: Synthetic PCR primer
gggaagaggcagggctgtcg

SEQ ID NO: 506 - DNA, 20 bp, Artificial Sequence
  Description of Artificial Sequence: Synthetic PCR primer
gagtgacgatgagccccggg

SEQ ID NO: 507 - DNA, 20 bp, Artificial Sequence
  Description of Artificial Sequence: Synthetic PCR primer
cccatgaggggtttgagtgc

SEQ ID NO: 508 - DNA, 20 bp, Artificial Sequence
  Description of Artificial Sequence: Synthetic PCR primer
cacctggggcatctgggtgg

SEQ ID NO: 509 - DNA, 20 bp, Artificial Sequence
  Description of Artificial Sequence: Synthetic PCR primer
tcatgatccccaaaagggct

SEQ ID NO: 510 - DNA, 21 bp, Artificial Sequence
  Description of Artificial Sequence: Synthetic PCR primer
tggtgcccagaatagtggcca

SEQ ID NO: 511 - DNA, 20 bp, Artificial Sequence
  Description of Artificial Sequence: Synthetic PCR primer
gcctcagacaaccctgcccc

SEQ ID NO: 512 - DNA, 22 bp, Artificial Sequence
  Description of Artificial Sequence: Synthetic PCR primer
gccgggacaagactgagttggg

SEQ ID NO: 513 - DNA, 20 bp, Artificial Sequence
  Description of Artificial Sequence: Synthetic PCR primer
tgctgcaggtggttccggag

SEQ ID NO: 514 - DNA, 21 bp, Artificial Sequence
  Description of Artificial Sequence: Synthetic PCR primer
acactggtccaggtcccgtct

SEQ ID NO: 515 - DNA, 20 bp, Artificial Sequence
  Description of Artificial Sequence: Synthetic PCR primer
atcgcgcccaaagcacaggt

SEQ ID NO: 516 - DNA, 22 bp, Artificial Sequence
  Description of Artificial Sequence: Synthetic PCR primer
ccctcatggtggtcttacggca

SEQ ID NO: 517 - DNA, 20 bp, Artificial Sequence
  Description of Artificial Sequence: Synthetic PCR primer
tgcgtcgctcatgctgggag

SEQ ID NO: 518 - DNA, 20 bp, Artificial Sequence
  Description of Artificial Sequence: Synthetic PCR primer
gagctgagacggcaccactg

SEQ ID NO: 519 - DNA, 20 bp, Artificial Sequence
  Description of Artificial Sequence: Synthetic PCR primer
agtgagagtggcacgaacca

SEQ ID NO: 520 - DNA, 20 bp, Artificial Sequence
  Description of Artificial Sequence: Synthetic PCR primer
gggagaaccttgtccagcct

SEQ ID NO: 521 - DNA, 20 bp, Artificial Sequence
  Description of Artificial Sequence: Synthetic PCR primer
cttcccagtgtggcccgtcc

SEQ ID NO: 522 - DNA, 20 bp, Artificial Sequence
  Description of Artificial Sequence: Synthetic PCR primer
ctgagagggggagggggagg

SEQ ID NO: 523 - DNA, 20 bp, Artificial Sequence
  Description of Artificial Sequence: Synthetic PCR primer
cagcctgctgcatcggaaaa

SEQ ID NO: 524 - DNA, 20 bp, Artificial Sequence
  Description of Artificial Sequence: Synthetic PCR primer
tccctctgacccggaaccca

SEQ ID NO: 525 - DNA, 20 bp, Artificial Sequence
  Description of Artificial Sequence: Synthetic PCR primer
tgggggttgcgtgcttgtca

SEQ ID NO: 526 - DNA, 20 bp, Artificial Sequence
  Description of Artificial Sequence: Synthetic PCR primer
atcaggtgccaggaggacac

SEQ ID NO: 527 - DNA, 24 bp, Artificial Sequence
  Description of Artificial Sequence: Synthetic PCR primer
tgagccacatgaatcaaggcctcc

SEQ ID NO: 528 - DNA, 20 bp, Artificial Sequence
  Description of Artificial Sequence: Synthetic PCR primer
ggtccctctgtgcagtggaa

SEQ ID NO: 529 - DNA, 20 bp, Artificial Sequence
  Description of Artificial Sequence: Synthetic PCR primer
gcgaggctgctgacttccct

SEQ ID NO: 530 - DNA, 20 bp, Artificial Sequence
  Description of Artificial Sequence: Synthetic PCR primer
attgcaggcgtgtccaggca

SEQ ID NO: 531 - DNA, 27 bp, Artificial Sequence
  Description of Artificial Sequence: Synthetic PCR primer
tgctctgccatttatgtcctatgaact

SEQ ID NO: 532 - DNA, 20 bp, Artificial Sequence
  Description of Artificial Sequence: Synthetic PCR primer
tccgcccaaacaggaggcag

SEQ ID NO: 533 - DNA, 20 bp, Artificial Sequence
  Description of Artificial Sequence: Synthetic PCR primer
gggggtctggctcacctgga

SEQ ID NO: 534 - DNA, 27 bp, Artificial Sequence
  Description of Artificial Sequence: Synthetic PCR primer
tcctggttcatttgctagaactctgga

SEQ ID NO: 535 - DNA, 20 bp, Artificial Sequence
  Description of Artificial Sequence: Synthetic PCR primer
cgtgtggtgagcctgagtct

SEQ ID NO: 536 - DNA, 25 bp, Artificial Sequence
  Description of Artificial Sequence: Synthetic PCR primer
aggccctgataattcatgctaccaa

SEQ ID NO: 537 - skipped

SEQ ID NO: 538 - DNA, 20 bp, Artificial Sequence
  Description of Artificial Sequence: Synthetic PCR primer
tccagatggcacattgtcag

SEQ ID NO: 539 - DNA, 20 bp, Artificial Sequence
  Description of Artificial Sequence: Synthetic PCR primer
gcaggcaagctgtcaagggt

SEQ ID NO: 540 - DNA, 20 bp, Artificial Sequence
  Description of Artificial Sequence: Synthetic PCR primer
gagggggaagtcaccgacaa

SEQ ID NO: 541 - DNA, 22 bp, Artificial Sequence
  Description of Artificial Sequence: Synthetic PCR primer
gacaccccacacactctcatgc

SEQ ID NO: 542 - DNA, 20 bp, Artificial Sequence
  Description of Artificial Sequence: Synthetic PCR primer
tcctttgaggttcatccccc

SEQ ID NO: 543 - DNA, 20 bp, Artificial Sequence
  Description of Artificial Sequence: Synthetic PCR primer
cagggccaggaacacaggaa

SEQ ID NO: 544 - DNA, 22 bp, Artificial Sequence
  Description of Artificial Sequence: Synthetic PCR primer
tgcagcctgagtgagcaagtgt

SEQ ID NO: 545 - DNA, 20 bp, Artificial Sequence
  Description of Artificial Sequence: Synthetic PCR primer
tacagcctgggtgatggagc

SEQ ID NO: 546 - DNA, 25 bp, Artificial Sequence
  Description of Artificial Sequence: Synthetic PCR primer
ggcaggcattaaactcatcaggtcc

SEQ ID NO: 547 - DNA, 20 bp, Artificial Sequence
  Description of Artificial Sequence: Synthetic PCR primer
gggcctccctgctggttctc

SEQ ID NO: 548 - DNA, 20 bp, Artificial Sequence
  Description of Artificial Sequence: Synthetic PCR primer
acaaacgcaggtggaccgaa

SEQ ID NO: 549 - DNA, 19 bp, Artificial Sequence
  Description of Artificial Sequence: Synthetic PCR primer
aggggaggggacattgcct

SEQ ID NO: 550 - DNA, 20 bp, Artificial Sequence
  Description of Artificial Sequence: Synthetic PCR primer
ctaatgcttacggctgcggg

SEQ ID NO: 551 - DNA, 20 bp, Artificial Sequence
  Description of Artificial Sequence: Synthetic PCR primer
gagcgaagttaacccaccgc

SEQ ID NO: 552 - DNA, 27 bp, Artificial Sequence
  Description of Artificial Sequence: Synthetic PCR primer
gcatgtgtctaactggagacaatagca

SEQ ID NO: 553 - DNA, 20 bp, Artificial Sequence
  Description of Artificial Sequence: Synthetic PCR primer
gcccctcccgccttttgtgt

SEQ ID NO: 554 - DNA, 23 bp, Artificial Sequence
  Description of Artificial Sequence: Synthetic PCR primer
gcctcagctctgctcttaagccc

SEQ ID NO: 555 - DNA, 20 bp, Artificial Sequence
  Description of Artificial Sequence: Synthetic PCR primer
ctccagagcctggcctacca

SEQ ID NO: 556 - DNA, 23 bp, Artificial Sequence
  Description of Artificial Sequence: Synthetic PCR primer
tctgtcaccacacagttaccacc

SEQ ID NO: 557 - DNA, 20 bp, Artificial Sequence
  Description of Artificial Sequence: Synthetic PCR primer
ggggaccctcaagaggcact

SEQ ID NO: 558 - DNA, 20 bp, Artificial Sequence
  Description of Artificial Sequence: Synthetic PCR primer
tgtggagggtgggacctggt

SEQ ID NO: 559 - DNA, 20 bp, Artificial Sequence
  Description of Artificial Sequence: Synthetic PCR primer
cggggtggcagtgacgtcaa

SEQ ID NO: 560 - DNA, 20 bp, Artificial Sequence
  Description of Artificial Sequence: Synthetic PCR primer
agctgaggcagagtccccga

SEQ ID NO: 561 - DNA, 20 bp, Artificial Sequence
  Description of Artificial Sequence: Synthetic PCR primer
accaccagaccccacctcca

SEQ ID NO: 562 - DNA, 20 bp, Artificial Sequence
  Description of Artificial Sequence: Synthetic PCR primer
gggtcaggacgcaggtcaga

SEQ ID NO: 563 - DNA, 22 bp, Artificial Sequence
  Description of Artificial Sequence: Synthetic PCR primer
acactctgggctaggtgctgga

SEQ ID NO: 564 - DNA, 20 bp, Artificial Sequence
  Description of Artificial Sequence: Synthetic PCR primer
ggggccattcctctgctgca

SEQ ID NO: 565 - DNA, 22 bp, Artificial Sequence
  Description of Artificial Sequence: Synthetic PCR primer
acacactggctcgcattcacca

SEQ ID NO: 566 - DNA, 23 bp, Artificial Sequence
  Description of Artificial Sequence: Synthetic PCR primer
tgggcacgtagtaaactgcacca

SEQ ID NO: 567 - DNA, 20 bp, Artificial Sequence
  Description of Artificial Sequence: Synthetic PCR primer
tcagctggtcctgggcttgg

SEQ ID NO: 568 - DNA, 20 bp, Artificial Sequence
  Description of Artificial Sequence: Synthetic PCR primer
agacacagccagggcctcag

SEQ ID NO: 569 - DNA, 21 bp, Artificial Sequence
  Description of Artificial Sequence: Synthetic PCR primer
acactctcacacacgcaccaa

SEQ ID NO: 570 - DNA, 20 bp, Artificial Sequence
  Description of Artificial Sequence: Synthetic PCR primer
actgcctgcatttccccggt

SEQ ID NO: 571 - DNA, 20 bp, Artificial Sequence
  Description of Artificial Sequence: Synthetic PCR primer
gccaggttcattgactgccc

SEQ ID NO: 572 - DNA, 20 bp, Artificial Sequence
  Description of Artificial Sequence: Synthetic PCR primer
cgagggagccgagttcgtaa

SEQ ID NO: 573 - DNA, 22 bp, Artificial Sequence
  Description of Artificial Sequence: Synthetic PCR primer
tcctcgggaagtcatggcttca

SEQ ID NO: 574 - DNA, 20 bp, Artificial Sequence
  Description of Artificial Sequence: Synthetic PCR primer
taaaccgttgcccccgcctc

SEQ ID NO: 575 - DNA, 20 bp, Artificial Sequence
  Description of Artificial Sequence: Synthetic PCR primer
cctgctgagactccaggtcc

SEQ ID NO: 576 - DNA, 20 bp, Artificial Sequence
  Description of Artificial Sequence: Synthetic PCR primer
ctcggggactgacaagccgg

SEQ ID NO: 577 - DNA, 20 bp, Artificial Sequence
  Description of Artificial Sequence: Synthetic PCR primer
ccccgaccaaagcaggagca

SEQ ID NO: 578 - DNA, 20 bp, Artificial Sequence
  Description of Artificial Sequence: Synthetic PCR primer
atttcagagccccggggaaa

SEQ ID NO: 579 - DNA, 24 bp, Artificial Sequence
  Description of Artificial Sequence: Synthetic PCR primer
gccagtggcttagtgtctttgtgt

SEQ ID NO: 580 - DNA, 22 bp, Artificial Sequence
  Description of Artificial Sequence: Synthetic PCR primer
tgccagaagaacatgggccaga

SEQ ID NO: 581 - DNA, 20 bp, Artificial Sequence
  Description of Artificial Sequence: Synthetic PCR primer
gcgtgtctctgtgtgcgtgc

SEQ ID NO: 582 - DNA, 25 bp, Artificial Sequence
  Description of Artificial Sequence: Synthetic PCR primer
tgcccagtccaatatttcagcagct

SEQ ID NO: 583 - DNA, 27 bp, Artificial Sequence
  Description of Artificial Sequence: Synthetic PCR primer
gggtgaaaatttggtactgttagctgt

SEQ ID NO: 584 - DNA, 21 bp, Artificial Sequence
  Description of Artificial Sequence: Synthetic PCR primer
tgccccatcaatcacctcggc

SEQ ID NO: 585 - DNA, 20 bp, Artificial Sequence
  Description of Artificial Sequence: Synthetic PCR primer
gcctcctctgccgctggtaa

SEQ ID NO: 586 - DNA, 20 bp, Artificial Sequence
  Description of Artificial Sequence: Synthetic PCR primer
gccaccaaaatagccagcgt

SEQ ID NO: 587 - DNA, 27 bp, Artificial Sequence
  Description of Artificial Sequence: Synthetic PCR primer
acagactgacccttgaaaaataccagt

SEQ ID NO: 588 - DNA, 25 bp, Artificial Sequence
  Description of Artificial Sequence: Synthetic PCR primer
agccaaatttctcaacagcagcact

SEQ ID NO: 589 - DNA, 20 bp, Artificial Sequence
  Description of Artificial Sequence: Synthetic PCR primer
acctccttgtgctgcctggc

SEQ ID NO: 590 - DNA, 27 bp, Artificial Sequence
  Description of Artificial Sequence: Synthetic PCR primer
cacaaagctctacctttccagtagtgt

SEQ ID NO: 591 - DNA, 21 bp, Artificial Sequence
  Description of Artificial Sequence: Synthetic PCR primer
tgtggggattacctgcctggc

SEQ ID NO: 592 - DNA, 22 bp, Artificial Sequence
  Description of Artificial Sequence: Synthetic PCR primer
tgaggcagaccagtcatccagc

SEQ ID NO: 593 - DNA, 20 bp, Artificial Sequence
  Description of Artificial Sequence: Synthetic PCR primer
attagctgggcgtggcggag

SEQ ID NO: 594 - DNA, 24 bp, Artificial Sequence
  Description of Artificial Sequence: Synthetic PCR primer
tgaagcagaaggagtggagaagga

SEQ ID NO: 595 - DNA, 20 bp, Artificial Sequence
  Description of Artificial Sequence: Synthetic PCR primer
tggtggagtgtgtgtgtggt

SEQ ID NO: 596 - DNA, 21 bp, Artificial Sequence
  Description of Artificial Sequence: Synthetic PCR primer
gcccctgtacgtcctgacagc

SEQ ID NO: 597 - DNA, 20 bp, Artificial Sequence
  Description of Artificial Sequence: Synthetic PCR primer
agcgcaggtaaacaggccca

SEQ ID NO: 598 - DNA, 20 bp, Artificial Sequence
  Description of Artificial Sequence: Synthetic PCR primer
atgggtgccaggtaccacgc

SEQ ID NO: 599 - DNA, 20 bp, Artificial Sequence
  Description of Artificial Sequence: Synthetic PCR primer
cgggcgggtggacagatgag

SEQ ID NO: 600 - DNA, 26 bp, Artificial Sequence
  Description of Artificial Sequence: Synthetic PCR primer
tcaacctagtgaacacagaccactga

SEQ ID NO: 601 - DNA, 20 bp, Artificial Sequence
  Description of Artificial Sequence: Synthetic PCR primer
gccagggccagtggattgct

SEQ ID NO: 602 - DNA, 20 bp, Artificial Sequence
  Description of Artificial Sequence: Synthetic PCR primer
gagccccaccggttcagtcc

SEQ ID NO: 603 - skipped

SEQ ID NO: 604 - DNA, 20 bp, Artificial Sequence
  Description of Artificial Sequence: Synthetic PCR primer
ggagcagctggtcagagggg

SEQ ID NO: 605 - DNA, 25 bp, Artificial Sequence
  Description of Artificial Sequence: Synthetic PCR primer
tctctccttcaactcatgaccagct

SEQ ID NO: 606 - DNA, 23 bp, Artificial Sequence
  Description of Artificial Sequence: Synthetic PCR primer
tggggaatctccaaagaaccccc

SEQ ID NO: 607 - DNA, 20 bp, Artificial Sequence
  Description of Artificial Sequence: Synthetic PCR primer
gatggccccactgagcacgt

SEQ ID NO: 608 - DNA, 27 bp, Artificial Sequence
  Description of Artificial Sequence: Synthetic PCR primer
aggattaatgtttaaagtcactggtgg

SEQ ID NO: 609 - DNA, 24 bp, Artificial Sequence
  Description of Artificial Sequence: Synthetic PCR primer
tccaagccactggtttctcagtca

SEQ ID NO: 610 - DNA, 22 bp, Artificial Sequence
  Description of Artificial Sequence: Synthetic PCR primer
actttcagagcttggggcaggt

SEQ ID NO: 611 - DNA, 20 bp, Artificial Sequence
  Description of Artificial Sequence: Synthetic PCR primer
caaagcatgcctttcagccg

SEQ ID NO: 612 - DNA, 20 bp, Artificial Sequence
  Description of Artificial Sequence: Synthetic PCR primer
ggactccctgcagctccagc

SEQ ID NO: 613 - DNA, 20 bp, Artificial Sequence
  Description of Artificial Sequence: Synthetic PCR primer
ccctttaggcaccttcccca

SEQ ID NO: 614 - DNA, 24 bp, Artificial Sequence
  Description of Artificial Sequence: Synthetic PCR primer
tgattctgccttagagtcccaggt

SEQ ID NO: 615 - DNA, 20 bp, Artificial Sequence
  Description of Artificial Sequence: Synthetic PCR primer
aggcaggagagcaagcaggt

SEQ ID NO: 616 - DNA, 20 bp, Artificial Sequence
  Description of Artificial Sequence: Synthetic PCR primer
ctccccattgcgacccgagg

SEQ ID NO: 617 - DNA, 20 bp, Artificial Sequence
  Description of Artificial Sequence: Synthetic PCR primer
ctggagcccagcaggaaggc

SEQ ID NO: 618 - DNA, 20 bp, Artificial Sequence
  Description of Artificial Sequence: Synthetic PCR primer
actgtgggcgttgtccccac

SEQ ID NO: 619 - DNA, 22 bp, Artificial Sequence
  Description of Artificial Sequence: Synthetic PCR primer
ggcgctccctttttccctttgt

SEQ ID NO: 620 - DNA, 21 bp, Artificial Sequence
  Description of Artificial Sequence: Synthetic PCR primer
tgccatctatagcagccccct

SEQ ID NO: 621 - DNA, 24 bp, Artificial Sequence
  Description of Artificial Sequence: Synthetic PCR primer
gtggagacgctaaacctgtgaggt

SEQ ID NO: 622 - DNA, 24 bp, Artificial Sequence
  Description of Artificial Sequence: Synthetic PCR primer
ccgaacttctgctgagcttgatgc

SEQ ID NO: 623 - DNA, 20 bp, Artificial Sequence
  Description of Artificial Sequence: Synthetic PCR primer
tgcccccaagacctttctcc

SEQ ID NO: 624 - DNA, 20 bp, Artificial Sequence
  Description of Artificial Sequence: Synthetic PCR primer
gggtggggccattgtgggtt

SEQ ID NO: 625 - DNA, 23 bp, Artificial Sequence
  Description of Artificial Sequence: Synthetic PCR primer
tggagaacatgagaggcttgcaa

SEQ ID NO: 626 - DNA, 20 bp, Artificial Sequence
  Description of Artificial Sequence: Synthetic PCR primer
gccacatggtagaagtcggc

SEQ ID NO: 627 - DNA, 20 bp, Artificial Sequence
  Description of Artificial Sequence: Synthetic PCR primer
tgtacaccccaagtcctccc

SEQ ID NO: 628 - DNA, 22 bp, Artificial Sequence
  Description of Artificial Sequence: Synthetic PCR primer
aggtctggctagagatgcagca

SEQ ID NO: 629 - DNA, 22 bp, Artificial Sequence
  Description of Artificial Sequence: Synthetic PCR primer
ccaagaggacccagctgttgga

SEQ ID NO: 630 - DNA, 26 bp, Artificial Sequence
  Description of Artificial Sequence: Synthetic PCR primer
accatctcttcattgatgagtcccaa

SEQ ID NO: 631 - DNA, 20 bp, Artificial Sequence
  Description of Artificial Sequence: Synthetic PCR primer
ggctgcggggagatgagctc

SEQ ID NO: 632 - DNA, 20 bp, Artificial Sequence
  Description of Artificial Sequence: Synthetic PCR primer
tcttccaggagggcagctcc

SEQ ID NO: 633 - DNA, 20 bp, Artificial Sequence
  Description of Artificial Sequence: Synthetic PCR primer
gagctgcactggatggcact

SEQ ID NO: 634 - DNA, 21 bp, Artificial Sequence
  Description of Artificial Sequence: Synthetic PCR primer
tctgggaaggtgaggaggcca

SEQ ID NO: 635 - DNA, 20 bp, Artificial Sequence
  Description of Artificial Sequence: Synthetic PCR primer
cttgctcccagcctgacccc

SEQ ID NO: 636 - DNA, 25 bp, Artificial Sequence
  Description of Artificial Sequence: Synthetic PCR primer
gggatttttatctgttgggtgcgaa

SEQ ID NO: 637 - DNA, 20 bp, Artificial Sequence
  Description of Artificial Sequence: Synthetic PCR primer
acccatcaggaccgcagcac

SEQ ID NO: 638 - DNA, 20 bp, Artificial Sequence
  Description of Artificial Sequence: Synthetic PCR primer
cgtccctcacagccagcctc

SEQ ID NO: 639 - DNA, 22 bp, Artificial Sequence
  Description of Artificial Sequence: Synthetic PCR primer
ccctctgcaaggtggagtctcc

SEQ ID NO: 640 - DNA, 21 bp, Artificial Sequence
  Description of Artificial Sequence: Synthetic PCR primer
ggcttccactgctgaaggcct

SEQ ID NO: 641 - DNA, 22 bp, Artificial Sequence
  Description of Artificial Sequence: Synthetic PCR primer
agcattgcctgtcgggtgatgt

SEQ ID NO: 642 - DNA, 21 bp, Artificial Sequence
  Description of Artificial Sequence: Synthetic PCR primer
tctagagcaggggcacaatgc

SEQ ID NO: 643 - DNA, 27 bp, Artificial Sequence
  Description of Artificial Sequence: Synthetic PCR primer
ggtctcagaaaatggagagaaagcacg

SEQ ID NO: 644 - DNA, 26 bp, Artificial Sequence
  Description of Artificial Sequence: Synthetic PCR primer
ggttgctgataccaaaacgtttgcct

SEQ ID NO: 645 - DNA, 27 bp, Artificial Sequence
  Description of Artificial Sequence: Synthetic PCR primer
actctccttaagtactgatatggctgt

SEQ ID NO: 646 - DNA, 21 bp, Artificial Sequence
  Description of Artificial Sequence: Synthetic PCR primer
caatgcctgcagtcctcagga

SEQ ID NO: 647 - DNA, 20 bp, Artificial Sequence
  Description of Artificial Sequence: Synthetic PCR primer
gcattggctgcccagggaaa

SEQ ID NO: 648 - DNA, 21 bp, Artificial Sequence
  Description of Artificial Sequence: Synthetic PCR primer
ccacaagcctcagcctacccg

SEQ ID NO: 649 - DNA, 25 bp, Artificial Sequence
  Description of Artificial Sequence: Synthetic PCR primer
gcctcttgcaaatgagactcctttt

SEQ ID NO: 650 - DNA, 20 bp, Artificial Sequence
  Description of Artificial Sequence: Synthetic PCR primer
tcccagaatctgcctccgca

SEQ ID NO: 651 - skipped

SEQ ID NO: 652 - DNA, 30 bp, Artificial Sequence
  Description of Artificial Sequence: Synthetic PCR primer
tcctaaaaatcagttttgagatttacttcc

SEQ ID NO: 653 - DNA, 26 bp, Artificial Sequence
  Description of Artificial Sequence: Synthetic PCR primer
acatctggggaaagcaaaagtcaaca

SEQ ID NO: 654 - DNA, 26 bp, Artificial Sequence
  Description of Artificial Sequence: Synthetic PCR primer
acgatcttgcttcatttccctgtaca

SEQ ID NO: 655 - DNA, 23 bp, Artificial Sequence
  Description of Artificial Sequence: Synthetic PCR primer
gcaccttggtgctgctaaatgcc

SEQ ID NO: 656 - DNA, 20 bp, Artificial Sequence
  Description of Artificial Sequence: Synthetic PCR primer
aactgtcctgcatccccgcc

SEQ ID NO: 657 - DNA, 20 bp, Artificial Sequence
  Description of Artificial Sequence: Synthetic PCR primer
catcaccctccaccaggccc

SEQ ID NO: 658 - DNA, 20 bp, Artificial Sequence
  Description of Artificial Sequence: Synthetic PCR primer
cctgacccgtggttcccgac

SEQ ID NO: 659 - DNA, 25 bp, Artificial Sequence
  Description of Artificial Sequence: Synthetic PCR primer
tgggaacattggagaagtttcctga

SEQ ID NO: 660 - DNA, 21 bp, Artificial Sequence
  Description of Artificial Sequence: Synthetic PCR primer
agccttggcaagcaactccct

SEQ ID NO: 661 - DNA, 20 bp, Artificial Sequence
  Description of Artificial Sequence: Synthetic PCR primer
ggcagcggacttcagagcca

SEQ ID NO: 662 - DNA, 20 bp, Artificial Sequence
  Description of Artificial Sequence: Synthetic PCR primer
ccagcctggtcaatatggca

SEQ ID NO: 663 - DNA, 20 bp, Artificial Sequence
  Description of Artificial Sequence: Synthetic PCR primer
atgccaacactcgaggggcc

SEQ ID NO: 664 - DNA, 20 bp, Artificial Sequence
  Description of Artificial Sequence: Synthetic PCR primer
ttgctctagtggggaggggg

SEQ ID NO: 665 - DNA, 26 bp, Artificial Sequence
  Description of Artificial Sequence: Synthetic PCR primer
agctgaagatagcagtgtttaagcct

SEQ ID NO: 666 - DNA, 22 bp, Artificial Sequence
  Description of Artificial Sequence: Synthetic PCR primer
agtcactggagtaagcctgcct

SEQ ID NO: 667 - DNA, 20 bp, Artificial Sequence
  Description of Artificial Sequence: Synthetic PCR primer
gggtctccctcagtgccctg

SEQ ID NO: 668 - DNA, 21 bp, Artificial Sequence
  Description of Artificial Sequence: Synthetic PCR primer
tgggggctgttaagaggcaca

SEQ ID NO: 669 - DNA, 26 bp, Artificial Sequence
  Description of Artificial Sequence: Synthetic PCR primer
tcaaaacagattgaccaaggccaaat

SEQ ID NO: 670 - DNA, 24 bp, Artificial Sequence
  Description of Artificial Sequence: Synthetic PCR primer
tctggcaccaggactgattgtaca

SEQ ID NO: 671 - DNA, 25 bp, Artificial Sequence
  Description of Artificial Sequence: Synthetic PCR primer
agcatctgtgataccctacctgtct

SEQ ID NO: 672 - DNA, 20 bp, Artificial Sequence
  Description of Artificial Sequence: Synthetic PCR primer
tagtcttgttgcccaggctg

SEQ ID NO: 673 - DNA, 20 bp, Artificial Sequence
  Description of Artificial Sequence: Synthetic PCR primer
ctgcaaccagggcccttacc

SEQ ID NO: 674 - DNA, 20 bp, Artificial Sequence
  Description of Artificial Sequence: Synthetic PCR primer
gcctggagagcaagcctggg

SEQ ID NO: 675 - DNA, 26 bp, Artificial Sequence
  Description of Artificial Sequence: Synthetic PCR primer
agtgaaacaaacaagcagcagtctga

SEQ ID NO: 676 - DNA, 24 bp, Artificial Sequence
  Description of Artificial Sequence: Synthetic PCR primer
aggctcagagaggtaagcaatgga

SEQ ID NO: 677 - DNA, 25 bp, Artificial Sequence
  Description of Artificial Sequence: Synthetic PCR primer
tcagagatgttaaagccttggtggg

SEQ ID NO: 678 - DNA, 22 bp, Artificial Sequence
  Description of Artificial Sequence: Synthetic PCR primer
tgtgctttctggggtagtggca

SEQ ID NO: 679 - DNA, 22 bp, Artificial Sequence
  Description of Artificial Sequence: Synthetic PCR primer
ccattgggtgactgaatgcaca

SEQ ID NO: 680 - DNA, 24 bp, Artificial Sequence
  Description of Artificial Sequence: Synthetic PCR primer
accaagaaagtgaaaaggaaaccc

SEQ ID NO: 681 - DNA, 22 bp, Artificial Sequence
  Description of Artificial Sequence: Synthetic PCR primer
agggtggggactgaaaggagct

SEQ ID NO: 682 - DNA, 22 bp, Artificial Sequence
  Description of Artificial Sequence: Synthetic PCR primer
accagtgctgtgtgaccttgga

SEQ ID NO: 683 - DNA, 21 bp, Artificial Sequence
  Description of Artificial Sequence: Synthetic PCR primer
ccaggtgtggtggttcatgac

SEQ ID NO: 684 - DNA, 21 bp, Artificial Sequence
  Description of Artificial Sequence: Synthetic PCR primer
caggcgctgggttcttagcct

SEQ ID NO: 685 - DNA, 20 bp, Artificial Sequence
  Description of Artificial Sequence: Synthetic PCR primer
tggggtccaagatgtcccct

SEQ ID NO: 686 - DNA, 21 bp, Artificial Sequence
  Description of Artificial Sequence: Synthetic PCR primer
gctgggcttggtggtatatgc

SEQ ID NO: 687 - DNA, 23 bp, Artificial Sequence
  Description of Artificial Sequence: Synthetic PCR primer
agttggtgtcactgacaatggga

SEQ ID NO: 688 - DNA, 23 bp, Artificial Sequence
  Description of Artificial Sequence: Synthetic PCR primer
agaggaggcacaattcaacccct

SEQ ID NO: 689 - DNA, 23 bp, Artificial Sequence
  Description of Artificial Sequence: Synthetic PCR primer
gggaaagtttgggaaagtcagca

SEQ ID NO: 690 - DNA, 23 bp, Artificial Sequence
  Description of Artificial Sequence: Synthetic PCR primer
tggtgcatcaaagggttgcttct

SEQ ID NO: 691 - DNA, 20 bp, Artificial Sequence
  Description of Artificial Sequence: Synthetic PCR primer
cccaggctgcccatcacact

SEQ ID NO: 692 - DNA, 20 bp, Artificial Sequence
  Description of Artificial Sequence: Synthetic PCR primer
tcagtgcccctgggtcctca

SEQ ID NO: 693 - DNA, 26 bp, Artificial Sequence
  Description of Artificial Sequence: Synthetic PCR primer
agcactcccttttgaattttggtgct

SEQ ID NO: 694 - DNA, 20 bp, Artificial Sequence
  Description of Artificial Sequence: Synthetic PCR primer
gaaaccggtccctggtgcca

SEQ ID NO: 695 - DNA, 20 bp, Artificial Sequence
  Description of Artificial Sequence: Synthetic PCR primer
ttgcgggtccctgtggagtc

SEQ ID NO: 696 - skipped

SEQ ID NO: 697 - DNA, 23 bp, Artificial Sequence
  Description of Artificial Sequence: Synthetic PCR primer
gccctacatctgctctccctcca

SEQ ID NO: 698 - DNA, 20 bp, Artificial Sequence
  Description of Artificial Sequence: Synthetic PCR primer
ttggagtgtggcccgggttg

SEQ ID NO: 699 - DNA, 20 bp, Artificial Sequence
  Description of Artificial Sequence: Synthetic PCR primer
cacaccatgctgatccaggc

SEQ ID NO: 700 - DNA, 20 bp, Artificial Sequence
  Description of Artificial Sequence: Synthetic PCR primer
ctccagggctcgctgtccac

SEQ ID NO: 701 - DNA, 20 bp, Artificial Sequence
  Description of Artificial Sequence: Synthetic PCR primer
ctgtggtagccgtggccagg

SEQ ID NO: 702 - DNA, 20 bp, Artificial Sequence
  Description of Artificial Sequence: Synthetic PCR primer
ggtggcgggacttgaatgag

SEQ ID NO: 703 - DNA, 20 bp, Artificial Sequence
  Description of Artificial Sequence: Synthetic PCR primer
ccagaggtggggccctgtga

SEQ ID NO: 704 - DNA, 24 bp, Artificial Sequence
  Description of Artificial Sequence: Synthetic PCR primer
tgtgactggttgtcctgctttcct

SEQ ID NO: 705 - DNA, 20 bp, Artificial Sequence
  Description of Artificial Sequence: Synthetic PCR primer
ctggccaaggggtgagtggg

SEQ ID NO: 706 - DNA, 20 bp, Artificial Sequence
  Description of Artificial Sequence: Synthetic PCR primer
acggtgtgctggctgctctt

SEQ ID NO: 707 - DNA, 21 bp, Artificial Sequence
  Description of Artificial Sequence: Synthetic PCR primer
tggtttgggcctcagggatgg

SEQ ID NO: 708 - DNA, 21 bp, Artificial Sequence
  Description of Artificial Sequence: Synthetic PCR primer
tggtttgggcctcagggatgg

SEQ ID NO: 709 - DNA, 21 bp, Artificial Sequence
  Description of Artificial Sequence: Synthetic PCR primer
tccaagtcagcgatgagggct

SEQ ID NO: 710 - DNA, 20 bp, Artificial Sequence
  Description of Artificial Sequence: Synthetic PCR primer
cacccctctcagcttcccaa

SEQ ID NO: 711 - DNA, 20 bp, Artificial Sequence
  Description of Artificial Sequence: Synthetic PCR primer
agaccccttggccaagcaca

SEQ ID NO: 712 - DNA, 20 bp, Artificial Sequence
  Description of Artificial Sequence: Synthetic PCR primer
acatgtgggaggcggacaga

SEQ ID NO: 713 - DNA, 20 bp, Artificial Sequence
  Description of Artificial Sequence: Synthetic PCR primer
ggacgactgtgcctgggaca

SEQ ID NO: 714 - DNA, 20 bp, Artificial Sequence
  Description of Artificial Sequence: Synthetic PCR primer
ggagagctcagcgccaggtc

SEQ ID NO: 715 - DNA, 21 bp, Artificial Sequence
  Description of Artificial Sequence: Synthetic PCR primer
gctgaagtgctctggggtgct

SEQ ID NO: 716 - DNA, 20 bp, Artificial Sequence
  Description of Artificial Sequence: Synthetic PCR primer
tcggggtgcacatggccatc

SEQ ID NO: 717 - DNA, 20 bp, Artificial Sequence
  Description of Artificial Sequence: Synthetic PCR primer
ctcgtgggaggccaacacct

SEQ ID NO: 718 - DNA, 20 bp, Artificial Sequence
  Description of Artificial Sequence: Synthetic PCR primer
gcatgcctttaatcccggct

SEQ ID NO: 719 - DNA, 20 bp, Artificial Sequence
  Description of Artificial Sequence: Synthetic PCR primer
cgcccagccacaaagtgcat

SEQ ID NO: 720 - DNA, 26 bp, Artificial Sequence
  Description of Artificial Sequence: Synthetic PCR primer
agctcacaagaattggaggtaacagt

SEQ ID NO: 721 - DNA, 20 bp, Artificial Sequence
  Description of Artificial Sequence: Synthetic PCR primer
aaactgggctgggcttccgg

SEQ ID NO: 722 - DNA, 20 bp, Artificial Sequence
  Description of Artificial Sequence: Synthetic PCR primer
gcaggtaggcagtctggggc

SEQ ID NO: 723 - DNA, 20 bp, Artificial Sequence
  Description of Artificial Sequence: Synthetic PCR primer
gcaggtaggcagtctggggc

SEQ ID NO: 724 - DNA, 20 bp, Artificial Sequence
  Description of Artificial Sequence: Synthetic PCR primer
gcaggtaggcagtctggggc

SEQ ID NO: 725 - DNA, 20 bp, Artificial Sequence
  Description of Artificial Sequence: Synthetic PCR primer
gctctggggtagaaggaggc

SEQ ID NO: 726 - DNA, 20 bp, Artificial Sequence
  Description of Artificial Sequence: Synthetic PCR primer
tgacatgttgtgtgctgggc

SEQ ID NO: 727 - DNA, 23 bp, Artificial Sequence
  Description of Artificial Sequence: Synthetic PCR primer
tcctggtgagatcgtccacagga

SEQ ID NO: 728 - DNA, 27 bp, Artificial Sequence
  Description of Artificial Sequence: Synthetic PCR primer
tcctaatccaagtcctttgttcagaca

SEQ ID NO: 729 - DNA, 20 bp, Artificial Sequence
  Description of Artificial Sequence: Synthetic PCR primer
gggacaccagttccttccat

SEQ ID NO: 730 - DNA, 25 bp, Artificial Sequence
  Description of Artificial Sequence: Synthetic PCR primer
acaccactatcaaggcagagtaggt

SEQ ID NO: 731 - DNA, 20 bp, Artificial Sequence
  Description of Artificial Sequence: Synthetic PCR primer
ctgggagcggagggaagtgc

SEQ ID NO: 732 - DNA, 20 bp, Artificial Sequence
  Description of Artificial Sequence: Synthetic PCR primer
cgggtctcggaatgcctcca

SEQ ID NO: 733 - DNA, 20 bp, Artificial Sequence
  Description of Artificial Sequence: Synthetic PCR primer
ttgctgtggtcccggtggtg

SEQ ID NO: 734 - DNA, 20 bp, Artificial Sequence
  Description of Artificial Sequence: Synthetic PCR primer
ggtgtggtgacaggtcgggt

SEQ ID NO: 735 - DNA, 20 bp, Artificial Sequence
  Description of Artificial Sequence: Synthetic PCR primer
ctcccaggacagtgctcggc

SEQ ID NO: 736 - DNA, 22 bp, Artificial Sequence
  Description of Artificial Sequence: Synthetic PCR primer
tgcgtaggttttgcctctgtga

SEQ ID NO: 737 - DNA, 20 bp, Artificial Sequence
  Description of Artificial Sequence: Synthetic PCR primer
ctccgcagccaccgttggta

SEQ ID NO: 738 - DNA, 22 bp, Artificial Sequence
  Description of Artificial Sequence: Synthetic PCR primer
acctgcagcatgaactctcgca

SEQ ID NO: 739 - DNA, 23 bp, Artificial Sequence
  Description of Artificial Sequence: Synthetic PCR primer
tctccagtttcttgctctcatgg

SEQ ID NO: 740 - DNA, 22 bp, Artificial Sequence
  Description of Artificial Sequence: Synthetic PCR primer
tggggtggtggtcttgaatcca

SEQ ID NO: 741 - DNA, 21 bp, Artificial Sequence
  Description of Artificial Sequence: Synthetic PCR primer
agcagccagtccagtgtcctg

SEQ ID NO: 742 - DNA, 20 bp, Artificial Sequence
  Description of Artificial Sequence: Synthetic PCR primer
tggacgctgctgggaggaga

SEQ ID NO: 743 - DNA, 22 bp, Artificial Sequence
  Description of Artificial Sequence: Synthetic PCR primer
aggtttgcactctgttgcctgg

SEQ ID NO: 744 - DNA, 22 bp, Artificial Sequence
  Description of Artificial Sequence: Synthetic PCR primer
tcttcctttgccaggcagcaca

SEQ ID NO: 745 - DNA, 20 bp, Artificial Sequence
  Description of Artificial Sequence: Synthetic PCR primer
ggacgcctactgcctggacc

SEQ ID NO: 746 - DNA, 20 bp, Artificial Sequence
  Description of Artificial Sequence: Synthetic PCR primer
aggcagtcatcgccttgcta

SEQ ID NO: 747 - DNA, 20 bp, Artificial Sequence
  Description of Artificial Sequence: Synthetic PCR primer
ccccagcccccaccagtttc

SEQ ID NO: 748 - DNA, 20 bp, Artificial Sequence
  Description of Artificial Sequence: Synthetic PCR primer
agggagcaggaaagtgaggt

SEQ ID NO: 749 - DNA, 20 bp, Artificial Sequence
  Description of Artificial Sequence: Synthetic PCR primer
acccagactcctggtgtggc

SEQ ID NO: 750 - DNA, 20 bp, Artificial Sequence
  Description of Artificial Sequence: Synthetic PCR primer
accaccctttcccccagaaa

SEQ ID NO: 751 - DNA, 21 bp, Artificial Sequence
  Description of Artificial Sequence: Synthetic PCR primer
gaatcactgcacctggccatc

SEQ ID NO: 752 - DNA, 20 bp, Artificial Sequence
  Description of Artificial Sequence: Synthetic PCR primer
taaagggcgtgctgggagag

SEQ ID NO: 753 - DNA, 20 bp, Artificial Sequence
  Description of Artificial Sequence: Synthetic PCR primer
tgcagggccatcttgtgtgt

SEQ ID NO: 754 - DNA, 20 bp, Artificial Sequence
  Description of Artificial Sequence: Synthetic PCR primer
ctgggtctgttccctgtggg

SEQ ID NO: 755 - DNA, 20 bp, Artificial Sequence
  Description of Artificial Sequence: Synthetic PCR primer
gcaggtcaagttggaacccg

SEQ ID NO: 756 - DNA, 21 bp, Artificial Sequence
  Description of Artificial Sequence: Synthetic PCR primer
agatttgtgcactgcctgcct

SEQ ID NO: 757 - DNA, 20 bp, Artificial Sequence
  Description of Artificial Sequence: Synthetic PCR primer
ggacctctgcacaccctggc

SEQ ID NO: 758 - DNA, 20 bp, Artificial Sequence
  Description of Artificial Sequence: Synthetic PCR primer
caggagggggaagtgtgtcc

SEQ ID NO: 759 - DNA, 22 bp, Artificial Sequence
  Description of Artificial Sequence: Synthetic PCR primer
gagagcaagtttgttccccagg

SEQ ID NO: 760 - DNA, 20 bp, Artificial Sequence
  Description of Artificial Sequence: Synthetic PCR primer
gctgctggtaggggagctgg

SEQ ID NO: 761 - DNA, 20 bp, Artificial Sequence
  Description of Artificial Sequence: Synthetic PCR primer
gggtgacgcttgccatgagc

SEQ ID NO: 762 - DNA, 21 bp, Artificial Sequence
  Description of Artificial Sequence: Synthetic PCR primer
gctgagacaaccagcccagct

SEQ ID NO: 763 - DNA, 20 bp, Artificial Sequence
  Description of Artificial Sequence: Synthetic PCR primer
gcagccgatccacactgggg

SEQ ID NO: 764 - DNA, 21 bp, Artificial Sequence
  Description of Artificial Sequence: Synthetic PCR primer
cccaggagcagggtacaatgc

SEQ ID NO: 765 - DNA, 21 bp, Artificial Sequence
  Description of Artificial Sequence: Synthetic PCR primer
ccttggaaggggccttggtgg

SEQ ID NO: 766 - DNA, 20 bp, Artificial Sequence
  Description of Artificial Sequence: Synthetic PCR primer
ggctgctgcgagttgccaac

SEQ ID NO: 767 - DNA, 20 bp, Artificial Sequence
  Description of Artificial Sequence: Synthetic PCR primer
gggttgcttgccctctgtgt

SEQ ID NO: 768 - DNA, 22 bp, Artificial Sequence
  Description of Artificial Sequence: Synthetic PCR primer
cacagaaggatgtgtgcaggtt

SEQ ID NO: 769 - DNA, 21 bp, Artificial Sequence
  Description of Artificial Sequence: Synthetic PCR primer
ggtcaggtgtgctgctaggca

SEQ ID NO: 770 - DNA, 21 bp, Artificial Sequence
  Description of Artificial Sequence: Synthetic PCR primer
actgcctgccaaagtgggtgt

SEQ ID NO: 771 - DNA, 20 bp, Artificial Sequence
  Description of Artificial Sequence: Synthetic PCR primer
tgccgggtaatagctggctt

SEQ ID NO: 772 - DNA, 20 bp, Artificial Sequence
  Description of Artificial Sequence: Synthetic PCR primer
gggggcttccaggtcacagg

SEQ ID NO: 773 - DNA, 23 bp, Artificial Sequence
  Description of Artificial Sequence: Synthetic PCR primer
acaggtccatgcttagcagaggg

SEQ ID NO: 774 - DNA, 20 bp, Artificial Sequence
  Description of Artificial Sequence: Synthetic PCR primer
ccgagtccgtggcagagagc

SEQ ID NO: 775 - DNA, 24 bp, Artificial Sequence
  Description of Artificial Sequence: Synthetic PCR primer
tggcccaattggaagtgatttcgt

SEQ ID NO: 776 - DNA, 22 bp, Artificial Sequence
  Description of Artificial Sequence: Synthetic PCR primer
ggcccaatcggtagaggatgca

SEQ ID NO: 777 - DNA, 20 bp, Artificial Sequence
  Description of Artificial Sequence: Synthetic PCR primer
tgcacccacacagccagcaa

SEQ ID NO: 778 - DNA, 20 bp, Artificial Sequence
  Description of Artificial Sequence: Synthetic PCR primer
aattagctgggcgcggtggt

SEQ ID NO: 779 - DNA, 20 bp, Artificial Sequence
  Description of Artificial Sequence: Synthetic PCR primer
caggcggccccttgaggaat

SEQ ID NO: 780 - DNA, 22 bp, Artificial Sequence
  Description of Artificial Sequence: Synthetic PCR primer
tgaggagaacaccacaggcaga

SEQ ID NO: 781 - DNA, 20 bp, Artificial Sequence
  Description of Artificial Sequence: Synthetic PCR primer
cccctcactcaagcaggccc

SEQ ID NO: 782 - DNA, 20 bp, Artificial Sequence
  Description of Artificial Sequence: Synthetic PCR primer
caggggcagtggcaggagtc

SEQ ID NO: 783 - DNA, 20 bp, Artificial Sequence
  Description of Artificial Sequence: Synthetic PCR primer
gggaagggggaacaggtgca

SEQ ID NO: 784 - DNA, 21 bp, Artificial Sequence
  Description of Artificial Sequence: Synthetic PCR primer
gctgctcgcagttaagcacca

SEQ ID NO: 785 - DNA, 20 bp, Artificial Sequence
  Description of Artificial Sequence: Synthetic PCR primer
ggttccacaagctgggggca

SEQ ID NO: 786 - DNA, 23 bp, Artificial Sequence
  Description of Artificial Sequence: Synthetic PCR primer
agagtcatccatttcctgggggc

SEQ ID NO: 787 - DNA, 27 bp, Artificial Sequence
  Description of Artificial Sequence: Synthetic PCR primer
agggaatcctttttccattgcttgttt

SEQ ID NO: 788 - DNA, 20 bp, Artificial Sequence
  Description of Artificial Sequence: Synthetic PCR primer
gcctcccctcctccttccca

SEQ ID NO: 789 - DNA, 20 bp, Artificial Sequence
  Description of Artificial Sequence: Synthetic PCR primer
tctgaccggtatgcctgacg

SEQ ID NO: 790 - DNA, 24 bp, Artificial Sequence
  Description of Artificial Sequence: Synthetic PCR primer
tggtctagtacttcctccagcctt

SEQ ID NO: 791 - DNA, 20 bp, Artificial Sequence
  Description of Artificial Sequence: Synthetic PCR primer
cccactgctcctagccctgc

SEQ ID NO: 792 - DNA, 27 bp, Artificial Sequence
  Description of Artificial Sequence: Synthetic PCR primer
agctttggtagttggagtctttgaagg

SEQ ID NO: 793 - DNA, 20 bp, Artificial Sequence
  Description of Artificial Sequence: Synthetic PCR primer
gcacagcctgcccttggaag

SEQ ID NO: 794 - DNA, 20 bp, Artificial Sequence
  Description of Artificial Sequence: Synthetic PCR primer
agcggcttctgcttctgcga

SEQ ID NO: 795 - DNA, 20 bp, Artificial Sequence
  Description of Artificial Sequence: Synthetic PCR primer
gagttcctcctcccgccagt

SEQ ID NO: 796 - DNA, 20 bp, Artificial Sequence
  Description of Artificial Sequence: Synthetic PCR primer
gcttttgcctgggactccgc

SEQ ID NO: 797 - DNA, 21 bp, Artificial Sequence
  Description of Artificial Sequence: Synthetic PCR primer
gctctgtcccacttcccctgg

SEQ ID NO: 798 - DNA, 21 bp, Artificial Sequence
  Description of Artificial Sequence: Synthetic PCR primer
cgcccctagagctaagggggt

SEQ ID NO: 799 - DNA, 21 bp, Artificial Sequence
  Description of Artificial Sequence: Synthetic PCR primer
agggctaggactgcagtgagc

SEQ ID NO: 800 - DNA, 21 bp, Artificial Sequence
  Description of Artificial Sequence: Synthetic PCR primer
gcctggggctgtgagtagttt

SEQ ID NO: 801 - DNA, 20 bp, Artificial Sequence
  Description of Artificial Sequence: Synthetic PCR primer
acttggcaggctgaggcagg

SEQ ID NO: 802 - DNA, 22 bp, Artificial Sequence
  Description of Artificial Sequence: Synthetic PCR primer
cagcagaaagttcatggtttcg

SEQ ID NO: 803 - DNA, 24 bp, Artificial Sequence
  Description of Artificial Sequence: Synthetic PCR primer
actgatcgatgatggcctatgggt

SEQ ID NO: 804 - DNA, 20 bp, Artificial Sequence
  Description of Artificial Sequence: Synthetic PCR primer
gcagcctattgtctcctggt

SEQ ID NO: 805 - DNA, 21 bp, Artificial Sequence
  Description of Artificial Sequence: Synthetic PCR primer
agcatcatgcctccagcttca

SEQ ID NO: 806 - DNA, 20 bp, Artificial Sequence
  Description of Artificial Sequence: Synthetic PCR primer
gcagctcccaccaccctcag

SEQ ID NO: 807 - DNA, 20 bp, Artificial Sequence
  Description of Artificial Sequence: Synthetic PCR primer
gtgcgtgtccgttcacccct

SEQ ID NO: 808 - DNA, 20 bp, Artificial Sequence
  Description of Artificial Sequence: Synthetic PCR primer
cgtgattcgagttcctggca

SEQ ID NO: 809 - DNA, 20 bp, Artificial Sequence
  Description of Artificial Sequence: Synthetic PCR primer
ctgcgagatgccccaaatcg

SEQ ID NO: 810 - DNA, 20 bp, Artificial Sequence
  Description of Artificial Sequence: Synthetic PCR primer
tgctgggattacaggcgcga

SEQ ID NO: 811 - DNA, 21 bp, Artificial Sequence
  Description of Artificial Sequence: Synthetic PCR primer
tgcctggccctctctgagtct

SEQ ID NO: 812 - DNA, 20 bp, Artificial Sequence
  Description of Artificial Sequence: Synthetic PCR primer
cagcgcagtccagcccgatg

SEQ ID NO: 813 - DNA, 24 bp, Artificial Sequence
  Description of Artificial Sequence: Synthetic PCR primer
gctacaggttgcacagtgagaggt

SEQ ID NO: 814 - DNA, 21 bp, Artificial Sequence
  Description of Artificial Sequence: Synthetic PCR primer
cccagccgttccaggtcttcc

SEQ ID NO: 815 - DNA, 20 bp, Artificial Sequence
  Description of Artificial Sequence: Synthetic PCR primer
tccagggtccttctcggccc

SEQ ID NO: 816 - DNA, 20 bp, Artificial Sequence
  Description of Artificial Sequence: Synthetic PCR primer
catggggctcggacctcgtc

SEQ ID NO: 817 - DNA, 20 bp, Artificial Sequence
  Description of Artificial Sequence: Synthetic PCR primer
tgccaggaaggaagctggcc

SEQ ID NO: 818 - DNA, 20 bp, Artificial Sequence
  Description of Artificial Sequence: Synthetic PCR primer
cccttagctgcagtcgcccc

SEQ ID NO: 819 - DNA, 20 bp, Artificial Sequence
  Description of Artificial Sequence: Synthetic PCR primer
tgaagatgggcagtttgggg

SEQ ID NO: 820 - DNA, 20 bp, Artificial Sequence
  Description of Artificial Sequence: Synthetic PCR primer
actggggttggggaggggat

SEQ ID NO: 821 - DNA, 22 bp, Artificial Sequence
  Description of Artificial Sequence: Synthetic PCR primer
ccatttgtgctgatctgtgggt

SEQ ID NO: 822 - DNA, 22 bp, Artificial Sequence
  Description of Artificial Sequence: Synthetic PCR primer
aggaaatgtgttgtgccagggc

SEQ ID NO: 823 - DNA, 27 bp, Artificial Sequence
  Description of Artificial Sequence: Synthetic PCR primer
gccaagtgttactcatcaagaaagtgg

SEQ ID NO: 824 - DNA, 20 bp, Artificial Sequence
  Description of Artificial Sequence: Synthetic PCR primer
tcccgaactcccgcaaaacg

SEQ ID NO: 825 - DNA, 20 bp, Artificial Sequence
  Description of Artificial Sequence: Synthetic PCR primer
ctggaaccgcatcctccgca

SEQ ID NO: 826 - DNA, 20 bp, Artificial Sequence
  Description of Artificial Sequence: Synthetic PCR primer
ggctgtgccttccgatggaa

SEQ ID NO: 827 - DNA, 26 bp, Artificial Sequence
  Description of Artificial Sequence: Synthetic PCR primer
aggcttctggaaaagtcctcaatgca

SEQ ID NO: 828 - DNA, 23 bp, Artificial Sequence
  Description of Artificial Sequence: Synthetic PCR primer
agccacacatctttctggtaggg

SEQ ID NO: 829 - DNA, 21 bp, Artificial Sequence
  Description of Artificial Sequence: Synthetic PCR primer
agggtggggtgtactggctca

SEQ ID NO: 830 - DNA, 20 bp, Artificial Sequence
  Description of Artificial Sequence: Synthetic PCR primer
tggccttgaactcttgggct

SEQ ID NO: 831 - DNA, 20 bp, Artificial Sequence
  Description of Artificial Sequence: Synthetic PCR primer
cagtaggtggtcccttccgc

SEQ ID NO: 832 - skipped

SEQ ID NO: 833 - DNA, 20 bp, Artificial Sequence
  Description of Artificial Sequence: Synthetic PCR primer
aagccgaaaagctgggcaaa

SEQ ID NO: 834 - DNA, 20 bp, Artificial Sequence
  Description of Artificial Sequence: Synthetic PCR primer
acacagtcagagctccgccg

SEQ ID NO: 835 - DNA, 21 bp, Artificial Sequence
  Description of Artificial Sequence: Synthetic PCR primer
tcgactggtcttgtcctccca

SEQ ID NO: 836 - DNA, 21 bp, Artificial Sequence
  Description of Artificial Sequence: Synthetic PCR primer
tgcagccaagagaaaaagcct

SEQ ID NO: 837 - DNA, 21 bp, Artificial Sequence
  Description of Artificial Sequence: Synthetic PCR primer
acccgacttcctccccattgc

SEQ ID NO: 838 - DNA, 20 bp, Artificial Sequence
  Description of Artificial Sequence: Synthetic PCR primer
gccaggaggacaccaggacc

SEQ ID NO: 839 - DNA, 20 bp, Artificial Sequence
  Description of Artificial Sequence: Synthetic PCR primer
ggcctgagagtggagagtgg

SEQ ID NO: 840 - DNA, 26 bp, Artificial Sequence
  Description of Artificial Sequence: Synthetic PCR primer
acctctccaagtctcagtaactctct

SEQ ID NO: 841 - DNA, 20 bp, Artificial Sequence
  Description of Artificial Sequence: Synthetic PCR primer
ctttggtggacctgcacagc

SEQ ID NO: 842 - DNA, 23 bp, Artificial Sequence
  Description of Artificial Sequence: Synthetic PCR primer
gctgggactacagacatgtgcca

SEQ ID NO: 843 - DNA, 23 bp, Artificial Sequence
  Description of Artificial Sequence: Synthetic PCR primer
aaatcctgcatggtgatgggagt

SEQ ID NO: 844 - DNA, 24 bp, Artificial Sequence
  Description of Artificial Sequence: Synthetic PCR primer
acagcctcttctccatgactgagc

SEQ ID NO: 845 - DNA, 20 bp, Artificial Sequence
  Description of Artificial Sequence: Synthetic PCR primer
gcggtggggaagccattgag

SEQ ID NO: 846 - DNA, 20 bp, Artificial Sequence
  Description of Artificial Sequence: Synthetic PCR primer
cctgtcgggagagtgcctgc

SEQ ID NO: 847 - DNA, 21 bp, Artificial Sequence
  Description of Artificial Sequence: Synthetic PCR primer
actccagatgcaaccagggct

SEQ ID NO: 848 - DNA, 20 bp, Artificial Sequence
  Description of Artificial Sequence: Synthetic PCR primer
gcttcaccgtagaggctgct

SEQ ID NO: 849 - DNA, 26 bp, Artificial Sequence
  Description of Artificial Sequence: Synthetic PCR primer
tcagtgacaaccttttgtattcggca

SEQ ID NO: 850 - DNA, 20 bp, Artificial Sequence
  Description of Artificial Sequence: Synthetic PCR primer
agggagcaggaaagtgaggt

SEQ ID NO: 851 - DNA, 20 bp, Artificial Sequence
  Description of Artificial Sequence: Synthetic PCR primer
caccgacacacccactcacc

SEQ ID NO: 852 - DNA, 20 bp, Artificial Sequence
  Description of Artificial Sequence: Synthetic PCR primer
tacccgggccgtctgttaga

SEQ ID NO: 853 - DNA, 20 bp, Artificial Sequence
  Description of Artificial Sequence: Synthetic PCR primer
tgaatcccttcacccccaag

SEQ ID NO: 854 - DNA, 20 bp, Artificial Sequence
  Description of Artificial Sequence: Synthetic PCR primer
ccaatccaggatgattccgc

SEQ ID NO: 855 - DNA, 20 bp, Artificial Sequence
  Description of Artificial Sequence: Synthetic PCR primer
gggaggtatgtgcgggagtg

SEQ ID NO: 856 - DNA, 20 bp, Artificial Sequence
  Description of Artificial Sequence: Synthetic PCR primer
gcccaggtgctaagcccctc

SEQ ID NO: 857 - DNA, 23 bp, Artificial Sequence
  Description of Artificial Sequence: Synthetic PCR primer
tgtgtcatggactttcccattgt

SEQ ID NO: 858 - DNA, 24 bp, Artificial Sequence
  Description of Artificial Sequence: Synthetic PCR primer
tctcccccaaggtatcagagagct

SEQ ID NO: 859 - DNA, 20 bp, Artificial Sequence
  Description of Artificial Sequence: Synthetic PCR primer
gctgccgtccgaacccaaga

SEQ ID NO: 860 - DNA, 21 bp, Artificial Sequence
  Description of Artificial Sequence: Synthetic PCR primer
actccgaaaatgccccgcagt

SEQ ID NO: 861 - DNA, 21 bp, Artificial Sequence
  Description of Artificial Sequence: Synthetic PCR primer
ttgagagggttcagtggttgc

SEQ ID NO: 862 - DNA, 20 bp, Artificial Sequence
  Description of Artificial Sequence: Synthetic PCR primer
agccaacggcagatgcaaat

SEQ ID NO: 863 - DNA, 20 bp, Artificial Sequence
  Description of Artificial Sequence: Synthetic PCR primer
cacacatgcacatgcccctg

SEQ ID NO: 864 - DNA, 21 bp, Artificial Sequence
  Description of Artificial Sequence: Synthetic PCR primer
tcccccatatcaacacacaca

SEQ ID NO: 865 - DNA, 24 bp, Artificial Sequence
  Description of Artificial Sequence: Synthetic PCR primer
tgggcaaaggacatgaaacagaca

SEQ ID NO: 866 - DNA, 27 bp, Artificial Sequence
  Description of Artificial Sequence: Synthetic PCR primer
acgaacagatcatttttcatggcttcc

SEQ ID NO: 867 - DNA, 20 bp, Artificial Sequence
  Description of Artificial Sequence: Synthetic PCR primer
ccctctccggaagtgccttg

SEQ ID NO: 868 - DNA, 20 bp, Artificial Sequence
  Description of Artificial Sequence: Synthetic PCR primer
gttgcctggggatggggtat

SEQ ID NO: 869 - DNA, 20 bp, Artificial Sequence
  Description of Artificial Sequence: Synthetic PCR primer
gggcatcaaaggatggggat

SEQ ID NO: 870 - DNA, 22 bp, Artificial Sequence
  Description of Artificial Sequence: Synthetic PCR primer
acagtgaggtgcggtctttggg

SEQ ID NO: 871 - DNA, 20 bp, Artificial Sequence
  Description of Artificial Sequence: Synthetic PCR primer
ggtgcagtccaagagccccc

SEQ ID NO: 872 - DNA, 20 bp, Artificial Sequence
  Description of Artificial Sequence: Synthetic PCR primer
gggagacagagcagcgcctc

SEQ ID NO: 873 - DNA, 22 bp, Artificial Sequence
  Description of Artificial Sequence: Synthetic PCR primer
aggacgacttgtgccccattca

SEQ ID NO: 874 - DNA, 20 bp, Artificial Sequence
  Description of Artificial Sequence: Synthetic PCR primer
tccacccacccacccatcct

SEQ ID NO: 875 - DNA, 21 bp, Artificial Sequence
  Description of Artificial Sequence: Synthetic PCR primer
gccccctcaccacatgatgct

SEQ ID NO: 876 - DNA, 20 bp, Artificial Sequence
  Description of Artificial Sequence: Synthetic PCR primer
tggggatccttgctcatggc

SEQ ID NO: 877 - DNA, 20 bp, Artificial Sequence
  Description of Artificial Sequence: Synthetic PCR primer
cctgcacgaggccaggtgtt

SEQ ID NO: 878 - DNA, 20 bp, Artificial Sequence
  Description of Artificial Sequence: Synthetic PCR primer
ctcgccgccgtgactgtagg

SEQ ID NO: 879 - DNA, 22 bp, Artificial Sequence
  Description of Artificial Sequence: Synthetic PCR primer
agagcactgggtagcagtcagt

SEQ ID NO: 880 - DNA, 20 bp, Artificial Sequence
  Description of Artificial Sequence: Synthetic PCR primer
ggtgggcgtgtgtgtgtacc

SEQ ID NO: 881 - DNA, 20 bp, Artificial Sequence
  Description of Artificial Sequence: Synthetic PCR primer
gagaagtcagggctggcggg

SEQ ID NO: 882 - DNA, 20 bp, Artificial Sequence
  Description of Artificial Sequence: Synthetic PCR primer
tggtgagggcttcagggagc

SEQ ID NO: 883 - DNA, 20 bp, Artificial Sequence
  Description of Artificial Sequence: Synthetic PCR primer
tccttctacacatcggcggc

SEQ ID NO: 884 - DNA, 20 bp, Artificial Sequence
  Description of Artificial Sequence: Synthetic PCR primer
ctgacctggggctctggtac

SEQ ID NO: 885 - DNA, 21 bp, Artificial Sequence
  Description of Artificial Sequence: Synthetic PCR primer
gcactgagcaaccaggagcac

SEQ ID NO: 886 - DNA, 20 bp, Artificial Sequence
  Description of Artificial Sequence: Synthetic PCR primer
gctcccctgccaggtgaacc

SEQ ID NO: 887 - DNA, 20 bp, Artificial Sequence
  Description of Artificial Sequence: Synthetic PCR primer
ctgcggagtggctggctata

SEQ ID NO: 888 - DNA, 20 bp, Artificial Sequence
  Description of Artificial Sequence: Synthetic PCR primer
ggagcagctcttccagggcc

SEQ ID NO: 889 - DNA, 20 bp, Artificial Sequence
  Description of Artificial Sequence: Synthetic PCR primer
ctggcagcctctggatgggg

SEQ ID NO: 890 - DNA, 20 bp, Artificial Sequence
  Description of Artificial Sequence: Synthetic PCR primer
aggccgcggtgttatggtta

SEQ ID NO: 891 - DNA, 25 bp, Artificial Sequence
  Description of Artificial Sequence: Synthetic PCR primer
tgacatattttcctgggccatgggt

SEQ ID NO: 892 - DNA, 27 bp, Artificial Sequence
  Description of Artificial Sequence: Synthetic PCR primer
ccatgctgacatcatatactgggaagc

SEQ ID NO: 893 - DNA, 20 bp, Artificial Sequence
  Description of Artificial Sequence: Synthetic PCR primer
ccaggctgggcacacaggtt

SEQ ID NO: 894 - DNA, 26 bp, Artificial Sequence
  Description of Artificial Sequence: Synthetic PCR primer
aggatgagttcatgtcctttgtgggg

SEQ ID NO: 895 - DNA, 27 bp, Artificial Sequence
  Description of Artificial Sequence: Synthetic PCR primer
aatgactcattccctgggtatctccca

SEQ ID NO: 896 - DNA, 20 bp, Artificial Sequence
  Description of Artificial Sequence: Synthetic PCR primer
caaggtcggcagggcagtga

SEQ ID NO: 897 - DNA, 24 bp, Artificial Sequence
  Description of Artificial Sequence: Synthetic PCR primer
tgagagttcctgttgctccacact

SEQ ID NO: 898 - DNA, 20 bp, Artificial Sequence
  Description of Artificial Sequence: Synthetic PCR primer
acatgcatctgtgtgtgcgt

SEQ ID NO: 899 - DNA, 27 bp, Artificial Sequence
  Description of Artificial Sequence: Synthetic PCR primer
tgtatctttcttgccaatggttttccc

SEQ ID NO: 900 - DNA, 23 bp, Artificial Sequence
  Description of Artificial Sequence: Synthetic PCR primer
tcctggagagcaggcatttttgt

SEQ ID NO: 901 - DNA, 20 bp, Artificial Sequence
  Description of Artificial Sequence: Synthetic PCR primer
ggcgggaaggtaaccctggg

SEQ ID NO: 902 - DNA, 23 bp, Artificial Sequence
  Description of Artificial Sequence: Synthetic PCR primer
tgatccgatggttgttcacagct

SEQ ID NO: 903 - DNA, 22 bp, Artificial Sequence
  Description of Artificial Sequence: Synthetic PCR primer
acgcacaaaaatgcccttgtca

SEQ ID NO: 904 - DNA, 20 bp, Artificial Sequence
  Description of Artificial Sequence: Synthetic PCR primer
gcccgagcacagtgtagggc

SEQ ID NO: 905 - DNA, 23 bp, Artificial Sequence
  Description of Artificial Sequence: Synthetic PCR primer
actgcatctcatctcaggcagct

SEQ ID NO: 906 - DNA, 27 bp, Artificial Sequence
  Description of Artificial Sequence: Synthetic PCR primer
tcagcttcacatctgtttcagttcagt

SEQ ID NO: 907 - DNA, 21 bp, Artificial Sequence
  Description of Artificial Sequence: Synthetic PCR primer
agagcagaaagagagtgccca

SEQ ID NO: 908 - DNA, 23 bp, Artificial Sequence
  Description of Artificial Sequence: Synthetic PCR primer
tgcacaagccacttagcctctct

SEQ ID NO: 909 - DNA, 21 bp, Artificial Sequence
  Description of Artificial Sequence: Synthetic PCR primer
tctctcgccccgtttccttgt

SEQ ID NO: 910 - DNA, 20 bp, Artificial Sequence
  Description of Artificial Sequence: Synthetic PCR primer
acagcaggaaggagccgcag

SEQ ID NO: 911 - DNA, 20 bp, Artificial Sequence
  Description of Artificial Sequence: Synthetic PCR primer
aggaggtctcgagccagggg

SEQ ID NO: 912 - DNA, 27 bp, Artificial Sequence
  Description of Artificial Sequence: Synthetic PCR primer
gtctatatacagcccacaacctcatgt

SEQ ID NO: 913 - DNA, 26 bp, Artificial Sequence
  Description of Artificial Sequence: Synthetic PCR primer
tgtcatttcttagtatgtcagccgga

SEQ ID NO: 914 - DNA, 20 bp, Artificial Sequence
  Description of Artificial Sequence: Synthetic PCR primer
gccagagctacccactcgcc

SEQ ID NO: 915 - DNA, 20 bp, Artificial Sequence
  Description of Artificial Sequence: Synthetic PCR primer
gggaagggggacactgggga

SEQ ID NO: 916 - DNA, 27 bp, Artificial Sequence
  Description of Artificial Sequence: Synthetic PCR primer
atctgcacatgtatgtacaggagtcat

SEQ ID NO: 917 - DNA, 24 bp, Artificial Sequence
  Description of Artificial Sequence: Synthetic PCR primer
agggtgtactgtgggaactttgca

SEQ ID NO: 918 - DNA, 26 bp, Artificial Sequence
  Description of Artificial Sequence: Synthetic PCR primer
acttcgtagagccttaaacatgtggc

SEQ ID NO: 919 - DNA, 23 bp, Artificial Sequence
  Description of Artificial Sequence: Synthetic PCR primer
tcaaacaaggtgcagatacagca

SEQ ID NO: 920 - DNA, 26 bp, Artificial Sequence
  Description of Artificial Sequence: Synthetic PCR primer
tgctctgtggatcatattttggggga

SEQ ID NO: 921 - DNA, 21 bp, Artificial Sequence
  Description of Artificial Sequence: Synthetic PCR primer
cccacgctgaagtgcaatggc

SEQ ID NO: 922 - DNA, 20 bp, Artificial Sequence
  Description of Artificial Sequence: Synthetic PCR primer
ggctcttcgatttggcacct

SEQ ID NO: 923 - DNA, 20 bp, Artificial Sequence
  Description of Artificial Sequence: Synthetic PCR primer
aggaacacaggccaggctgg

SEQ ID NO: 924 - DNA, 20 bp, Artificial Sequence
  Description of Artificial Sequence: Synthetic PCR primer
ccgaccttcatccctcctgg

SEQ ID NO: 925 - DNA, 21 bp, Artificial Sequence
  Description of Artificial Sequence: Synthetic PCR primer
tgggctctgtgtccctaccca

SEQ ID NO: 926 - DNA, 23 bp, Artificial Sequence
  Description of Artificial Sequence: Synthetic PCR primer
accctgactactgactgaccgct

SEQ ID NO: 927 - DNA, 23 bp, Artificial Sequence
  Description of Artificial Sequence: Synthetic PCR primer
agaggcattgacttggagcacct

SEQ ID NO: 928 - DNA, 20 bp, Artificial Sequence
  Description of Artificial Sequence: Synthetic PCR primer
cctcagggagggggcctgat

SEQ ID NO: 929 - DNA, 22 bp, Artificial Sequence
  Description of Artificial Sequence: Synthetic PCR primer
aggtcggtgcagggtttaagga

SEQ ID NO: 930 - DNA, 21 bp, Artificial Sequence
  Description of Artificial Sequence: Synthetic PCR primer
cgtcacccatcgtctcgtgga

SEQ ID NO: 931 - DNA, 27 bp, Artificial Sequence
  Description of Artificial Sequence: Synthetic PCR primer
gcatcttgctaaccgtacttcttctga

SEQ ID NO: 932 - DNA, 22 bp, Artificial Sequence
  Description of Artificial Sequence: Synthetic PCR primer
gctcctggcctcttcctacagc

SEQ ID NO: 933 - DNA, 23 bp, Artificial Sequence
  Description of Artificial Sequence: Synthetic PCR primer
ccaagtcaatgggcaacaaggga

SEQ ID NO: 934 - DNA, 20 bp, Artificial Sequence
  Description of Artificial Sequence: Synthetic PCR primer
atggcaggcagaggaggaag

SEQ ID NO: 935 - DNA, 20 bp, Artificial Sequence
  Description of Artificial Sequence: Synthetic PCR primer
ctggggccagggtttctgcc

SEQ ID NO: 936 - DNA, 24 bp, Artificial Sequence
  Description of Artificial Sequence: Synthetic PCR primer
tccttctgtaggcaatgggaacaa

SEQ ID NO: 937 - DNA, 20 bp, Artificial Sequence
  Description of Artificial Sequence: Synthetic PCR primer
ggcagatttcccccatgctg

SEQ ID NO: 938 - DNA, 20 bp, Artificial Sequence
  Description of Artificial Sequence: Synthetic PCR primer
aaggggagtgtgcaagcctc

SEQ ID NO: 939 - DNA, 24 bp, Artificial Sequence
  Description of Artificial Sequence: Synthetic PCR primer
agtccaacactcaggtgagaccct

SEQ ID NO: 940 - DNA, 27 bp, Artificial Sequence
  Description of Artificial Sequence: Synthetic PCR primer
gggtatggaattctggattagcagagc

SEQ ID NO: 941 - DNA, 22 bp, Artificial Sequence
  Description of Artificial Sequence: Synthetic PCR primer
acactgtgagtatgcttggcgt

SEQ ID NO: 942 - DNA, 22 bp, Artificial Sequence
  Description of Artificial Sequence: Synthetic PCR primer
tcggatgcttttccacagggct

SEQ ID NO: 943 - DNA, 24 bp, Artificial Sequence
  Description of Artificial Sequence: Synthetic PCR primer
ccaatcctgagctcctacaaggct

SEQ ID NO: 944 - DNA, 23 bp, Artificial Sequence
  Description of Artificial Sequence: Synthetic PCR primer
tgctggttaaggggtgttttgga

SEQ ID NO: 945 - DNA, 24 bp, Artificial Sequence
  Description of Artificial Sequence: Synthetic PCR primer
tgggggacaatggaaaagcaatga

SEQ ID NO: 946 - DNA, 20 bp, Artificial Sequence
  Description of Artificial Sequence: Synthetic PCR primer
agcccttgccatgcaggacc

SEQ ID NO: 947 - DNA, 24 bp, Artificial Sequence
  Description of Artificial Sequence: Synthetic PCR primer
aaccacagatgtaccctcaaagct

SEQ ID NO: 948 - DNA, 20 bp, Artificial Sequence
  Description of Artificial Sequence: Synthetic PCR primer
tctggaacctgggaggcgga

SEQ ID NO: 949 - DNA, 20 bp, Artificial Sequence
  Description of Artificial Sequence: Synthetic PCR primer
cctccttgggcctggggttc

SEQ ID NO: 950 - DNA, 21 bp, Artificial Sequence
  Description of Artificial Sequence: Synthetic PCR primer
agatgttctgtccccaggcct

SEQ ID NO: 951 - DNA, 20 bp, Artificial Sequence
  Description of Artificial Sequence: Synthetic PCR primer
tgccgctccacataccctcc

SEQ ID NO: 952 - DNA, 25 bp, Artificial Sequence
  Description of Artificial Sequence: Synthetic PCR primer
agcacctattggacactggttctct

SEQ ID NO: 953 - DNA, 21 bp, Artificial Sequence
  Description of Artificial Sequence: Synthetic PCR primer
tggagatggagcctggtggga

SEQ ID NO: 954 - DNA, 20 bp, Artificial Sequence
  Description of Artificial Sequence: Synthetic PCR primer
cccacagaaacctgggccct

SEQ ID NO: 955 - DNA, 21 bp, Artificial Sequence
  Description of Artificial Sequence: Synthetic PCR primer
tgggtcctctccacctctgca

SEQ ID NO: 956 - DNA, 22 bp, Artificial Sequence
  Description of Artificial Sequence: Synthetic PCR primer
cagaatcttgctctgttgccca

SEQ ID NO: 957 - DNA, 26 bp, Artificial Sequence
  Description of Artificial Sequence: Synthetic PCR primer
tcccaagagaaaactctgtcctgaca

SEQ ID NO: 958 - DNA, 20 bp, Artificial Sequence
  Description of Artificial Sequence: Synthetic PCR primer
tggctgtgctgggctgtgtt

SEQ ID NO: 959 - DNA, 21 bp, Artificial Sequence
  Description of Artificial Sequence: Synthetic PCR primer
acaggtgccaaaacactgcct

SEQ ID NO: 960 - DNA, 20 bp, Artificial Sequence
  Description of Artificial Sequence: Synthetic PCR primer
cgatcagtcccctggcgtcc

SEQ ID NO: 961 - DNA, 21 bp, Artificial Sequence
  Description of Artificial Sequence: Synthetic PCR primer
aggggtttccaggcacatggg

SEQ ID NO: 962 - skipped

SEQ ID NO: 963 - DNA, 30 bp, Artificial Sequence
  Description of Artificial Sequence: Synthetic PCR primer
aaagtgttagccaacatacagaagtcagga

SEQ ID NO: 964 - DNA, 27 bp, Artificial Sequence
  Description of Artificial Sequence: Synthetic PCR primer
tgtctgagtatctaggctaaaagtggt

SEQ ID NO: 965 - DNA, 27 bp, Artificial Sequence
  Description of Artificial Sequence: Synthetic PCR primer
agtgctttgtgaactgaaaagcaaaca

SEQ ID NO: 966 - DNA, 24 bp, Artificial Sequence
  Description of Artificial Sequence: Synthetic PCR primer
gggcaactgaacaggcatgaatgg

SEQ ID NO: 967 - DNA, 20 bp, Artificial Sequence
  Description of Artificial Sequence: Synthetic PCR primer
ggtgcacctggatccaccca

SEQ ID NO: 968 - DNA, 20 bp, Artificial Sequence
  Description of Artificial Sequence: Synthetic PCR primer
accactgctgcaggctccag

SEQ ID NO: 969 - DNA, 20 bp, Artificial Sequence
  Description of Artificial Sequence: Synthetic PCR primer
tggtgcgtggtgtgtgtggt

SEQ ID NO: 970 - DNA, 22 bp, Artificial Sequence
  Description of Artificial Sequence: Synthetic PCR primer
ccatgtgactactgggctgccc

SEQ ID NO: 971 - DNA, 27 bp, Artificial Sequence
  Description of Artificial Sequence: Synthetic PCR primer
ggttctctctctcagaaaagaaagagg

SEQ ID NO: 972 - DNA, 21 bp, Artificial Sequence
  Description of Artificial Sequence: Synthetic PCR primer
gccagaggctctcagcagtgc

SEQ ID NO: 973 - DNA, 20 bp, Artificial Sequence
  Description of Artificial Sequence: Synthetic PCR primer
actgtgcccagccccatatt

SEQ ID NO: 974 - DNA, 20 bp, Artificial Sequence
  Description of Artificial Sequence: Synthetic PCR primer
cgggttgtggcaccgggtta

SEQ ID NO: 975 - DNA, 27 bp, Artificial Sequence
  Description of Artificial Sequence: Synthetic PCR primer
agagttcaggcatgaaaagaagcaaca

SEQ ID NO: 976 - DNA, 23 bp, Artificial Sequence
  Description of Artificial Sequence: Synthetic PCR primer
tgcaatttgaggggctctcttca

SEQ ID NO: 977 - DNA, 25 bp, Artificial Sequence
  Description of Artificial Sequence: Synthetic PCR primer
tgccagccaaaagttgttagtgtgt

SEQ ID NO: 978 - DNA, 24 bp, Artificial Sequence
  Description of Artificial Sequence: Synthetic PCR primer
tgtgtggtagggagcaaaacgaca

SEQ ID NO: 979 - DNA, 20 bp, Artificial Sequence
  Description of Artificial Sequence: Synthetic PCR primer
tgaccacacacacccccacg

SEQ ID NO: 980 - DNA, 24 bp, Artificial Sequence
  Description of Artificial Sequence: Synthetic PCR primer
tgtgtttttaagctgcaccccagg

SEQ ID NO: 981 - DNA, 20 bp, Artificial Sequence
  Description of Artificial Sequence: Synthetic PCR primer
gcacgcagctgactcccaga

SEQ ID NO: 982 - DNA, 20 bp, Artificial Sequence
  Description of Artificial Sequence: Synthetic PCR primer
accagggctgccacagagtc

SEQ ID NO: 983 - DNA, 20 bp, Artificial Sequence
  Description of Artificial Sequence: Synthetic PCR primer
ctcggcccctgagagttcat

SEQ ID NO: 984 - DNA, 20 bp, Artificial Sequence
  Description of Artificial Sequence: Synthetic PCR primer
gagcagcagcaaagccaccg

SEQ ID NO: 985 - DNA, 20 bp, Artificial Sequence
  Description of Artificial Sequence: Synthetic PCR primer
agccgagacaatctgccccg

SEQ ID NO: 986 - DNA, 20 bp, Artificial Sequence
  Description of Artificial Sequence: Synthetic PCR primer
ggcaggtctgaccagtgggg

SEQ ID NO: 987 - DNA, 27 bp, Artificial Sequence
  Description of Artificial Sequence: Synthetic PCR primer
tgagtagacagaaatgttaccggtgtt

SEQ ID NO: 988 - DNA, 22 bp, Artificial Sequence
  Description of Artificial Sequence: Synthetic PCR primer
agtgaaccaagggaatggggga

SEQ ID NO: 989 - DNA, 22 bp, Artificial Sequence
  Description of Artificial Sequence: Synthetic PCR primer
cacctcagccctgtagtcctgg

SEQ ID NO: 990 - DNA, 20 bp, Artificial Sequence
  Description of Artificial Sequence: Synthetic PCR primer
gccactgtccccagcctatt

SEQ ID NO: 991 - DNA, 23 bp, Artificial Sequence
  Description of Artificial Sequence: Synthetic PCR primer
tgagatggcatacgatttaccca

SEQ ID NO: 992 - DNA, 26 bp, Artificial Sequence
  Description of Artificial Sequence: Synthetic PCR primer
tggcatcactcagagattggaacaca

SEQ ID NO: 993 - DNA, 22 bp, Artificial Sequence
  Description of Artificial Sequence: Synthetic PCR primer
tcctatgggaggggaggcttct

SEQ ID NO: 994 - DNA, 22 bp, Artificial Sequence
  Description of Artificial Sequence: Synthetic PCR primer
gcatacggcagtagaatgagcc

SEQ ID NO: 995 - DNA, 20 bp, Artificial Sequence
  Description of Artificial Sequence: Synthetic PCR primer
ccttcctgggccccatggtg

SEQ ID NO: 996 - DNA, 24 bp, Artificial Sequence
  Description of Artificial Sequence: Synthetic PCR primer
tgaaactgcttgatgaggtgtgga

SEQ ID NO: 997 - DNA, 25 bp, Artificial Sequence
  Description of Artificial Sequence: Synthetic PCR primer
acttgcaaagctgataactgactga

SEQ ID NO: 998 - DNA, 20 bp, Artificial Sequence
  Description of Artificial Sequence: Synthetic PCR primer
cgcagcgcacgagttcatca

SEQ ID NO: 999 - DNA, 20 bp, Artificial Sequence
  Description of Artificial Sequence: Synthetic PCR primer
ggctggggaggcctcacaat

SEQ ID NO: 1000 - DNA, 20 bp, Artificial Sequence
  Description of Artificial Sequence: Synthetic PCR primer
aggacaagctaccccacacc

SEQ ID NO: 1001 - DNA, 20 bp, Artificial Sequence
  Description of Artificial Sequence: Synthetic PCR primer
tcattccagcacgccgggag

SEQ ID NO: 1002 - DNA, 25 bp, Artificial Sequence
  Description of Artificial Sequence: Synthetic PCR primer
tggagtaagtataccttggggacct

SEQ ID NO: 1003 - DNA, 23 bp, Artificial Sequence
  Description of Artificial Sequence: Synthetic PCR primer
tgtgcaaatacctagcacggtgc

SEQ ID NO: 1004 - DNA, 26 bp, Artificial Sequence
  Description of Artificial Sequence: Synthetic PCR primer
actgaagtccagcctcttccatttca

SEQ ID NO: 1005 - DNA, 23 bp, Artificial Sequence
  Description of Artificial Sequence: Synthetic PCR primer
ggggagtagagggtagtgttgcc

SEQ ID NO: 1006 - DNA, 20 bp, Artificial Sequence
  Description of Artificial Sequence: Synthetic PCR primer
aggtgccgtgttgtgcccaa

SEQ ID NO: 1007 - skipped

SEQ ID NO: 1008 - DNA, 20 bp, Artificial Sequence
  Description of Artificial Sequence: Synthetic PCR primer
gggccgggaaagagttgctg

SEQ ID NO: 1009 - DNA, 24 bp, Artificial Sequence
  Description of Artificial Sequence: Synthetic PCR primer
acctctctttctctgcctcactgt

SEQ ID NO: 1010 - DNA, 20 bp, Artificial Sequence
  Description of Artificial Sequence: Synthetic PCR primer
gcagtacggaagcacgaagc

SEQ ID NO: 1011 - DNA, 20 bp, Artificial Sequence
  Description of Artificial Sequence: Synthetic PCR primer
ctgggctctgctggttcccc

SEQ ID NO: 1012 - DNA, 21 bp, Artificial Sequence
  Description of Artificial Sequence: Synthetic PCR primer
ccccataccacctctccggga

SEQ ID NO: 1013 - DNA, 20 bp, Artificial Sequence
  Description of Artificial Sequence: Synthetic PCR primer
ccagcgtgtttccaagggat

SEQ ID NO: 1014 - DNA, 23 bp, Artificial Sequence
  Description of Artificial Sequence: Synthetic PCR primer
tttccacactcagttctgcagga

SEQ ID NO: 1015 - DNA, 23 bp, Artificial Sequence
  Description of Artificial Sequence: Synthetic PCR primer
gcagtgttttgtggtgatgggca

SEQ ID NO: 1016 - DNA, 20 bp, Artificial Sequence
  Description of Artificial Sequence: Synthetic PCR primer
tgggaccccagcagccaatg

SEQ ID NO: 1017 - DNA, 20 bp, Artificial Sequence
  Description of Artificial Sequence: Synthetic PCR primer
acagtgctgaccgtgctggg

SEQ ID NO: 1018 - DNA, 24 bp, Artificial Sequence
  Description of Artificial Sequence: Synthetic PCR primer
tgcctcccacaaaaatgtctacct

SEQ ID NO: 1019 - DNA, 23 bp, Artificial Sequence
  Description of Artificial Sequence: Synthetic PCR primer
accccttatcccagaacccatga

SEQ ID NO: 1020 - DNA, 23 bp, Artificial Sequence
  Description of Artificial Sequence: Synthetic PCR primer
tgggagctgttcctttttggcca

SEQ ID NO: 1021 - DNA, 20 bp, Artificial Sequence
  Description of Artificial Sequence: Synthetic PCR primer
gctagagggtctgctgcctt

SEQ ID NO: 1022 - DNA, 20 bp, Artificial Sequence
  Description of Artificial Sequence: Synthetic PCR primer
cttgctctcaccccgcctcc

SEQ ID NO: 1023 - DNA, 25 bp, Artificial Sequence
  Description of Artificial Sequence: Synthetic PCR primer
tctcactttgctgttaccgatgtcg

SEQ ID NO: 1024 - DNA, 24 bp, Artificial Sequence
  Description of Artificial Sequence: Synthetic PCR primer
agtgcccagagtgttgtaactgct

SEQ ID NO: 1025 - DNA, 20 bp, Artificial Sequence
  Description of Artificial Sequence: Synthetic PCR primer
cagcgtggcccgtgggaata

SEQ ID NO: 1026 - DNA, 25 bp, Artificial Sequence
  Description of Artificial Sequence: Synthetic PCR primer
accccactgtggatgaattggtacc

SEQ ID NO: 1027 - DNA, 20 bp, Artificial Sequence
  Description of Artificial Sequence: Synthetic PCR primer
ttgcctcgcaggggaagcag

SEQ ID NO: 1028 - DNA, 22 bp, Artificial Sequence
  Description of Artificial Sequence: Synthetic PCR primer
agccaccaacacataccaggct

SEQ ID NO: 1029 - DNA, 22 bp, Artificial Sequence
  Description of Artificial Sequence: Synthetic PCR primer
aggatttcagagtgatggggct

SEQ ID NO: 1030 - DNA, 27 bp, Artificial Sequence
  Description of Artificial Sequence: Synthetic PCR primer
gcaaatttctgcacctactctaggcct

SEQ ID NO: 1031 - DNA, 22 bp, Artificial Sequence
  Description of Artificial Sequence: Synthetic PCR primer
gcagtcacccttcactgcctgt

SEQ ID NO: 1032 - DNA, 23 bp, Artificial Sequence
  Description of Artificial Sequence: Synthetic PCR primer
ggggctaaggcattgtcagaccc

SEQ ID NO: 1033 - DNA, 20 bp, Artificial Sequence
  Description of Artificial Sequence: Synthetic PCR primer
tctcctgcctcagcctccca

SEQ ID NO: 1034 - DNA, 20 bp, Artificial Sequence
  Description of Artificial Sequence: Synthetic PCR primer
tctcctgcctcagcctccca

SEQ ID NO: 1035 - DNA, 20 bp, Artificial Sequence
  Description of Artificial Sequence: Synthetic PCR primer
tctcctgcctcagcctccca

SEQ ID NO: 1036 - DNA, 20 bp, Artificial Sequence
  Description of Artificial Sequence: Synthetic PCR primer
ggcctgtcaaccaaccaacc

SEQ ID NO: 1037 - DNA, 20 bp, Artificial Sequence
  Description of Artificial Sequence: Synthetic PCR primer
aaatcctgcagcctcccctt

SEQ ID NO: 1038 - DNA, 20 bp, Artificial Sequence
  Description of Artificial Sequence: Synthetic PCR primer
tcctccccactcagcctccc

SEQ ID NO: 1039 - DNA, 22 bp, Artificial Sequence
  Description of Artificial Sequence: Synthetic PCR primer
agggaccagccactacccttca

SEQ ID NO: 1040 - DNA, 20 bp, Artificial Sequence
  Description of Artificial Sequence: Synthetic PCR primer
gggggagattggagttcccc

SEQ ID NO: 1041 - DNA, 20 bp, Artificial Sequence
  Description of Artificial Sequence: Synthetic PCR primer
tctgcctggggtgctttccc

SEQ ID NO: 1042 - DNA, 20 bp, Artificial Sequence
  Description of Artificial Sequence: Synthetic PCR primer
gccccgacagatgaggcctc

SEQ ID NO: 1043 - DNA, 20 bp, Artificial Sequence
  Description of Artificial Sequence: Synthetic PCR primer
acccaggaattgccaccccc

SEQ ID NO: 1044 - DNA, 20 bp, Artificial Sequence
  Description of Artificial Sequence: Synthetic PCR primer
gcagacactagagcccgccc

SEQ ID NO: 1045 - DNA, 20 bp, Artificial Sequence
  Description of Artificial Sequence: Synthetic PCR primer
acctgcgtctctgtgctgca

SEQ ID NO: 1046 - DNA, 19 bp, Artificial Sequence
  Description of Artificial Sequence: Synthetic PCR primer
cctggccccatgctgcctg

SEQ ID NO: 1047 - DNA, 24 bp, Artificial Sequence
  Description of Artificial Sequence: Synthetic PCR primer
agggaatgatgttttccaccccct

SEQ ID NO: 1048 - DNA, 22 bp, Artificial Sequence
  Description of Artificial Sequence: Synthetic PCR primer
tgcattgacgtacgatggctca

SEQ ID NO: 1049 - DNA, 24 bp, Artificial Sequence
  Description of Artificial Sequence: Synthetic PCR primer
acctgagcaacatgactcacctgg

SEQ ID NO: 1050 - DNA, 20 bp, Artificial Sequence
  Description of Artificial Sequence: Synthetic PCR primer
accattggtgaacccagtca

SEQ ID NO: 1051 - DNA, 25 bp, Artificial Sequence
  Description of Artificial Sequence: Synthetic PCR primer
tcagctataacctgggacttgtgct

SEQ ID NO: 1052 - DNA, 23 bp, Artificial Sequence
  Description of Artificial Sequence: Synthetic PCR primer
ccctttcatcgagaaccccaggg

SEQ ID NO: 1053 - DNA, 20 bp, Artificial Sequence
  Description of Artificial Sequence: Synthetic PCR primer
gaggtctcgggctgctcgtg

SEQ ID NO: 1054 - DNA, 21 bp, Artificial Sequence
  Description of Artificial Sequence: Synthetic PCR primer
tggggtgattggttgccaggt

SEQ ID NO: 1055 - DNA, 25 bp, Artificial Sequence
  Description of Artificial Sequence: Synthetic PCR primer
tgcaggaatagcaggtatgaggagt

SEQ ID NO: 1056 - DNA, 20 bp, Artificial Sequence
  Description of Artificial Sequence: Synthetic PCR primer
gccctggcagcccatggtac

SEQ ID NO: 1057 - DNA, 20 bp, Artificial Sequence
  Description of Artificial Sequence: Synthetic PCR primer
ggtcccaccttcccctacaa

SEQ ID NO: 1058 - DNA, 20 bp, Artificial Sequence
  Description of Artificial Sequence: Synthetic PCR primer
cagcccaggccacagcttca

SEQ ID NO: 1059 - DNA, 23 bp, Artificial Sequence
  Description of Artificial Sequence: Synthetic VEGFA on-target sequence
gggtggggggagtttgctcctgg

SEQ ID NO: 1060 - DNA, 23 bp, Artificial Sequence
  Description of Artificial Sequence: Synthetic VEGFA off-target sequence
ggatggagggagtttgctcctgg

SEQ ID NO: 1061 - DNA, 23 bp, Artificial Sequence
  Description of Artificial Sequence: Synthetic VEGFA off-target sequence
gggagggtggagtttgctcctgg

SEQ ID NO: 1062 - DNA, 23 bp, Artificial Sequence
  Description of Artificial Sequence: Synthetic VEGFA off-target sequence
cgggggagggagtttgctcctgg

SEQ ID NO: 1063 - DNA, 23 bp, Artificial Sequence
  Description of Artificial Sequence: Synthetic VEGFA off-target sequence
ggggaggggaagtttgctcctgg

SEQ ID NO: 1064 - DNA, 23 bp, Artificial Sequence
  Description of Artificial Sequence: Synthetic VEGFA on-target sequence
gaccccctccaccccgcctccgg

SEQ ID NO: 1065 - DNA, 23 bp, Artificial Sequence
  Description of Artificial Sequence: Synthetic VEGFA off-target sequence
gaccccccccaccccgcccccgg

SEQ ID NO: 1066 - DNA, 23 bp, Artificial Sequence
  Description of Artificial Sequence: Synthetic VEGFA off-target sequence
gggcccctccaccccgcctctgg

SEQ ID NO: 1067 - DNA, 23 bp, Artificial Sequence
  Description of Artificial Sequence: Synthetic VEGFA off-target sequence
ctacccctccaccccgcctccgg

SEQ ID NO: 1068 - DNA, 23 bp, Artificial Sequence
  Description of Artificial Sequence: Synthetic VEGFA off-target sequence
gcccccacccaccccgcctctgg

SEQ ID NO: 1069 - DNA, 23 bp, Artificial Sequence
  Description of Artificial Sequence: Synthetic VEGFA off-target sequence
taccccccacaccccgcctctgg

SEQ ID NO: 1070 - DNA, 23 bp, Artificial Sequence
  Description of Artificial Sequence: Synthetic VEGFA off-target sequence
acacccccccaccccgcctcagg

SEQ ID NO: 1071 - DNA, 23 bp, Artificial Sequence
  Description of Artificial Sequence: Synthetic VEGFA off-target sequence
attcccccccaccccgcctcagg

SEQ ID NO: 1072 - DNA, 23 bp, Artificial Sequence
  Description of Artificial Sequence: Synthetic VEGFA off-target sequence
ccccacccccaccccgcctcagg

SEQ ID NO: 1073 - DNA, 23 bp, Artificial Sequence
  Description of Artificial Sequence: Synthetic VEGFA off-target sequence
cgccctccccaccccgcctccgg

SEQ ID NO: 1074 - DNA, 23 bp, Artificial Sequence
  Description of Artificial Sequence: Synthetic VEGFA off-target sequence
ctccccacccaccccgcctcagg

SEQ ID NO: 1075 - DNA, 23 bp, Artificial Sequence
  Description of Artificial Sequence: Synthetic VEGFA off-target sequence
tgcccctcccaccccgcctctgg

SEQ ID NO: 1076 - DNA, 23 bp, Artificial Sequence
  Description of Artificial Sequence: Synthetic VEGFA off-target sequence
aggcccccacaccccgcctcagg

SEQ ID NO: 1077 - DNA, 23 bp, Artificial Sequence
  Description of Artificial Sequence: Synthetic VEGFA on-target sequence
ggtgagtgagtgtgtgcgtgtgg

SEQ ID NO: 1078 - DNA, 23 bp, Artificial Sequence
  Description of Artificial Sequence: Synthetic VEGFA off-target sequence
ggtgagtgagtgtgtgtgtgagg

SEQ ID NO: 1079 - DNA, 23 bp, Artificial Sequence
  Description of Artificial Sequence: Synthetic VEGFA off-target sequence
agtgagtgagtgtgtgtgtgggg

SEQ ID NO: 1080 - DNA, 23 bp, Artificial Sequence
  Description of Artificial Sequence: Synthetic VEGFA off-target sequence
gctgagtgagtgtatgcgtgtgg

SEQ ID NO: 1081 - DNA, 23 bp, Artificial Sequence
  Description of Artificial Sequence: Synthetic VEGFA off-target sequence
ggtgagtgagtgcgtgcgggtgg

SEQ ID NO: 1082 - DNA, 23 bp, Artificial Sequence
  Description of Artificial Sequence: Synthetic VEGFA off-target sequence
gttgagtgaatgtgtgcgtgagg

SEQ ID NO: 1083 - DNA, 23 bp, Artificial Sequence
  Description of Artificial Sequence: Synthetic VEGFA off-target sequence
tgtgggtgagtgtgtgcgtgagg

SEQ ID NO: 1084 - DNA, 23 bp, Artificial Sequence
  Description of Artificial Sequence: Synthetic VEGFA off-target sequence
agagagtgagtgtgtgcatgagg

SEQ ID NO: 1085 - DNA, 23 bp, Artificial Sequence
  Description of Artificial Sequence: Synthetic EMX1 on-target sequence
gagtccgagcagaagaagaaggg

SEQ ID NO: 1086 - DNA, 23 bp, Artificial Sequence
  Description of Artificial Sequence: Synthetic EMX1 off-target sequence
gagttagagcagaagaagaaagg

SEQ ID NO: 1087 - DNA, 23 bp, Artificial Sequence
  Description of Artificial Sequence: Synthetic RNF2 on-target sequence
gtcatcttagtcattacctgtgg

SEQ ID NO: 1088 - DNA, 23 bp, Artificial Sequence
  Description of Artificial Sequence: Synthetic FANCF on-target sequence
ggaatcccttctgcagcaccagg

SEQ ID NO: 1089 - DNA, 45 bp, Artificial Sequence
  Description of Artificial Sequence: Synthetic PCR primer
tggataaaaagtattctattggtttagccatcggcactaattccg

SEQ ID NO: 1090 - DNA, 45 bp, Artificial Sequence
  Description of Artificial Sequence: Synthetic PCR primer
cggaattagtgccgatggctaaaccaatagaatactttttatcca

SEQ ID NO: 1091 - DNA, 24 bp, Artificial Sequence
  Description of Artificial Sequence: Synthetic oligonucleotide for generating gRNA expression plasmid
acaccgcacgggcagcttgccggg

SEQ ID NO: 1092 - DNA, 24 bp, Artificial Sequence
  Description of Artificial Sequence: Synthetic oligonucleotide for generating gRNA expression plasmid
acaccgcacgggcagcttgccgcg

SEQ ID NO: 1093 - DNA, 24 bp, Artificial Sequence
  Description of Artificial Sequence: Synthetic oligonucleotide for generating gRNA expression plasmid
acaccgcacgggcagcttgcccgg

SEQ ID NO: 1094 - DNA, 24 bp, Artificial Sequence
  Description of Artificial Sequence: Synthetic oligonucleotide for generating gRNA expression plasmid
acaccgcacgggcagcttgcgggg

SEQ ID NO: 1095 - DNA, 24 bp, Artificial Sequence
  Description of Artificial Sequence: Synthetic oligonucleotide for generating gRNA expression plasmid
acaccgcacgggcagcttggcggg

SEQ ID NO: 1096 - DNA, 24 bp, Artificial Sequence
  Description of Artificial Sequence: Synthetic oligonucleotide for generating gRNA expression plasmid
acaccgcacgggcagcttcccggg

SEQ ID NO: 1097 - DNA, 24 bp, Artificial Sequence
  Description of Artificial Sequence: Synthetic oligonucleotide for generating gRNA expression plasmid
acaccgcacgggcagctagccggg

SEQ ID NO: 1098 - DNA, 24 bp, Artificial Sequence
  Description of Artificial Sequence: Synthetic oligonucleotide for generating gRNA expression plasmid
acaccgcacgggcagcatgccggg

SEQ ID NO: 1099 - DNA, 24 bp, Artificial Sequence
  Description of Artificial Sequence: Synthetic oligonucleotide for generating gRNA expression plasmid
acaccgcacgggcaggttgccggg

SEQ ID NO: 1100 - DNA, 24 bp, Artificial Sequence
  Description of Artificial Sequence: Synthetic oligonucleotide for generating gRNA expression plasmid
acaccgcacgggcaccttgccggg

SEQ ID NO: 1101 - DNA, 24 bp, Artificial Sequence
  Description of Artificial Sequence: Synthetic oligonucleotide for generating gRNA expression plasmid
acaccgcacgggctgcttgccggg

SEQ ID NO: 1102 - DNA, 24 bp, Artificial Sequence
  Description of Artificial Sequence: Synthetic oligonucleotide for generating gRNA expression plasmid
acaccgcacggggagcttgccggg

SEQ ID NO: 1103 - DNA, 24 bp, Artificial Sequence
  Description of Artificial Sequence: Synthetic oligonucleotide for generating gRNA expression plasmid
acaccgcacggccagcttgccggg

SEQ ID NO: 1104 - DNA, 24 bp, Artificial Sequence
  Description of Artificial Sequence: Synthetic oligonucleotide for generating gRNA expression plasmid
acaccgcacgcgcagcttgccggg

SEQ ID NO: 1105 - DNA, 24 bp, Artificial Sequence
  Description of Artificial Sequence: Synthetic oligonucleotide for generating gRNA expression plasmid
acaccgcaccggcagcttgccggg

SEQ ID NO: 1106 - DNA, 24 bp, Artificial Sequence
  Description of Artificial Sequence: Synthetic oligonucleotide for generating gRNA expression plasmid
acaccgcaggggcagcttgccggg

SEQ ID NO: 1107 - DNA, 24 bp, Artificial Sequence
  Description of Artificial Sequence: Synthetic oligonucleotide for generating gRNA expression plasmid
acaccgctcgggcagcttgccggg

SEQ ID NO: 1108 - DNA, 24 bp, Artificial Sequence
  Description of Artificial Sequence: Synthetic oligonucleotide for generating gRNA expression plasmid
acaccggacgggcagcttgccggg

SEQ ID NO: 1109 - DNA, 24 bp, Artificial Sequence
  Description of Artificial Sequence: Synthetic oligonucleotide for generating gRNA expression plasmid
acaccgcacgggcagcttgccccg

SEQ ID NO: 1110 - DNA, 24 bp, Artificial Sequence
  Description of Artificial Sequence: Synthetic oligonucleotide for generating gRNA expression plasmid
acaccgcacgggcagcttgggggg

SEQ ID NO: 1111 - DNA, 24 bp, Artificial Sequence
  Description of Artificial Sequence: Synthetic oligonucleotide for generating gRNA expression plasmid
acaccgcacgggcagctacccggg

SEQ ID NO: 1112 - DNA, 24 bp, Artificial Sequence
  Description of Artificial Sequence: Synthetic oligonucleotide for generating gRNA expression plasmid
acaccgcacgggcaggatgccggg

SEQ ID NO: 1113 - DNA, 24 bp, Artificial Sequence
  Description of Artificial Sequence: Synthetic oligonucleotide for generating gRNA expression plasmid
acaccgcacgggctccttgccggg

SEQ ID NO: 1114 - DNA, 24 bp, Artificial Sequence
  Description of Artificial Sequence: Synthetic oligonucleotide for generating gRNA expression plasmid
acaccgcacggcgagcttgccggg

SEQ ID NO: 1115 - DNA, 24 bp, Artificial Sequence
  Description of Artificial Sequence: Synthetic oligonucleotide for generating gRNA expression plasmid
acaccgcacccgcagcttgccggg

SEQ ID NO: 1116 - DNA, 24 bp, Artificial Sequence
  Description of Artificial Sequence: Synthetic oligonucleotide for generating gRNA expression plasmid
acaccgctggggcagcttgccggg

SEQ ID NO: 1117 - DNA, 24 bp, Artificial Sequence
  Description of Artificial Sequence: Synthetic oligonucleotide for generating gRNA expression plasmid
acaccggtcgggcagcttgccggg

SEQ ID NO: 1118 - DNA, 23 bp, Artificial Sequence
  Description of Artificial Sequence: Synthetic oligonucleotide for generating gRNA expression plasmid
acaccgccgttcttctgcttgtg

SEQ ID NO: 1119 - DNA, 23 bp, Artificial Sequence
  Description of Artificial Sequence: Synthetic oligonucleotide for generating gRNA expression plasmid
acaccgccgttcttctgcttgag

SEQ ID NO: 1120 - DNA, 23 bp, Artificial Sequence
  Description of Artificial Sequence: Synthetic oligonucleotide for generating gRNA expression plasmid
acaccgccgttcttctgcttctg

SEQ ID NO: 1121 - DNA, 23 bp, Artificial Sequence
  Description of Artificial Sequence: Synthetic oligonucleotide for generating gRNA expression plasmid
acaccgccgttcttctgctagtg

SEQ ID NO: 1122 - DNA, 23 bp, Artificial Sequence
  Description of Artificial Sequence: Synthetic oligonucleotide for generating gRNA expression plasmid
acaccgccgttcttctgcatgtg

SEQ ID NO: 1123 - DNA, 23 bp, Artificial Sequence
  Description of Artificial Sequence: Synthetic oligonucleotide for generating gRNA expression plasmid
acaccgccgttcttctggttgtg

SEQ ID NO: 1124 - DNA, 23 bp, Artificial Sequence
  Description of Artificial Sequence: Synthetic oligonucleotide for generating gRNA expression plasmid
acaccgccgttcttctccttgtg

SEQ ID NO: 1125 - DNA, 23 bp, Artificial Sequence
  Description of Artificial Sequence: Synthetic oligonucleotide for generating gRNA expression plasmid
acaccgccgttcttcagcttgtg

SEQ ID NO: 1126 - DNA, 23 bp, Artificial Sequence
  Description of Artificial Sequence: Synthetic oligonucleotide for generating gRNA expression plasmid
acaccgccgttcttgtgcttgtg

SEQ ID NO: 1127 - DNA, 23 bp, Artificial Sequence
  Description of Artificial Sequence: Synthetic oligonucleotide for generating gRNA expression plasmid
acaccgccgttctactgcttgtg

SEQ ID NO: 1128 - DNA, 23 bp, Artificial Sequence
  Description of Artificial Sequence: Synthetic oligonucleotide for generating gRNA expression plasmid
acaccgccgttcatctgcttgtg

SEQ ID NO: 1129 - DNA, 23 bp, Artificial Sequence
  Description of Artificial Sequence: Synthetic oligonucleotide for generating gRNA expression plasmid
acaccgccgttgttctgcttgtg

SEQ ID NO: 1130 - DNA, 23 bp, Artificial Sequence
  Description of Artificial Sequence: Synthetic oligonucleotide for generating gRNA expression plasmid
acaccgccgtacttctgcttgtg

SEQ ID NO: 1131 - DNA, 23 bp, Artificial Sequence
  Description of Artificial Sequence: Synthetic oligonucleotide for generating gRNA expression plasmid
acaccgccgatcttctgcttgtg

SEQ ID NO: 1132 - DNA, 23 bp, Artificial Sequence
  Description of Artificial Sequence: Synthetic oligonucleotide for generating gRNA expression plasmid
acaccgcccttcttctgcttgtg

SEQ ID NO: 1133 - DNA, 23 bp, Artificial Sequence
  Description of Artificial Sequence: Synthetic oligonucleotide for generating gRNA expression plasmid
acaccgcggttcttctgcttgtg

SEQ ID NO: 1134 - DNA, 23 bp, Artificial Sequence
  Description of Artificial Sequence: Synthetic oligonucleotide for generating gRNA expression plasmid
acaccggcgttcttctgcttgtg

SEQ ID NO: 1135 - DNA, 23 bp, Artificial Sequence
  Description of Artificial Sequence: Synthetic oligonucleotide for generating gRNA expression plasmid
acaccgccgttcttctgcttcag

SEQ ID NO: 1136 - DNA, 23 bp, Artificial Sequence
  Description of Artificial Sequence: Synthetic oligonucleotide for generating gRNA expression plasmid
acaccgccgttcttctgcaagtg

SEQ ID NO: 1137 - DNA, 23 bp, Artificial Sequence
  Description of Artificial Sequence: Synthetic oligonucleotide for generating gRNA expression plasmid
acaccgccgttcttctcgttgtg

SEQ ID NO: 1138 - DNA, 23 bp, Artificial Sequence
  Description of Artificial Sequence: Synthetic oligonucleotide for generating gRNA expression plasmid
acaccgccgttcttgagcttgtg

SEQ ID NO: 1139 - DNA, 23 bp, Artificial Sequence
  Description of Artificial Sequence: Synthetic oligonucleotide for generating gRNA expression plasmid
acaccgccgttcaactgcttgtg

SEQ ID NO: 1140 - DNA, 23 bp, Artificial Sequence
  Description of Artificial Sequence: Synthetic oligonucleotide for generating gRNA expression plasmid
acaccgccgtagttctgcttgtg

SEQ ID NO: 1141 - DNA, 23 bp, Artificial Sequence
  Description of Artificial Sequence: Synthetic oligonucleotide for generating gRNA expression plasmid
acaccgcccatcttctgcttgtg

SEQ ID NO: 1142 - DNA, 23 bp, Artificial Sequence
  Description of Artificial Sequence: Synthetic oligonucleotide for generating gRNA expression plasmid
acaccggggttcttctgcttgtg

SEQ ID NO: 1143 - DNA, 23 bp, Artificial Sequence
  Description of Artificial Sequence: Synthetic oligonucleotide for generating gRNA expression plasmid
acaccggtgcagatgaacttcag

SEQ ID NO: 1144 - DNA, 23 bp, Artificial Sequence
  Description of Artificial Sequence: Synthetic oligonucleotide for generating gRNA expression plasmid
acaccggtgcagatgaacttctg

SEQ ID NO: 1145 - DNA, 23 bp, Artificial Sequence
  Description of Artificial Sequence: Synthetic oligonucleotide for generating gRNA expression plasmid
acaccggtgcagatgaacttgag

SEQ ID NO: 1146 - DNA, 23 bp, Artificial Sequence
  Description of Artificial Sequence: Synthetic oligonucleotide for generating gRNA expression plasmid
acaccggtgcagatgaactacag

SEQ ID NO: 1147 - DNA, 23 bp, Artificial Sequence
  Description of Artificial Sequence: Synthetic oligonucleotide for generating gRNA expression plasmid
acaccggtgcagatgaacatcag

SEQ ID NO: 1148 - DNA, 23 bp, Artificial Sequence
  Description of Artificial Sequence: Synthetic oligonucleotide for generating gRNA expression plasmid
acaccggtgcagatgaagttcag

SEQ ID NO: 1149 - DNA, 23 bp, Artificial Sequence
  Description of Artificial Sequence: Synthetic oligonucleotide for generating gRNA expression plasmid
acaccggtgcagatgatcttcag

SEQ ID NO: 1150 - DNA, 23 bp, Artificial Sequence
  Description of Artificial Sequence: Synthetic oligonucleotide for generating gRNA expression plasmid
acaccggtgcagatgtacttcag

SEQ ID NO: 1151 - DNA, 23 bp, Artificial Sequence
  Description of Artificial Sequence: Synthetic oligonucleotide for generating gRNA expression plasmid
acaccggtgcagatcaacttcag

SEQ ID NO: 1152 - DNA, 23 bp, Artificial Sequence
  Description of Artificial Sequence: Synthetic oligonucleotide for generating gRNA expression plasmid
acaccggtgcagaagaacttcag

SEQ ID NO: 1153 - DNA, 23 bp, Artificial Sequence
  Description of Artificial Sequence: Synthetic oligonucleotide for generating gRNA expression plasmid
acaccggtgcagttgaacttcag

SEQ ID NO: 1154 - DNA, 23 bp, Artificial Sequence
  Description of Artificial Sequence: Synthetic oligonucleotide for generating gRNA expression plasmid
acaccggtgcacatgaacttcag

SEQ ID NO: 1155 - DNA, 23 bp, Artificial Sequence
  Description of Artificial Sequence: Synthetic oligonucleotide for generating gRNA expression plasmid
acaccggtgctgatgaacttcag

SEQ ID NO: 1156 - DNA, 23 bp, Artificial Sequence
  Description of Artificial Sequence: Synthetic oligonucleotide for generating gRNA expression plasmid
acaccggtggagatgaacttcag

SEQ ID NO: 1157 - DNA, 23 bp, Artificial Sequence
  Description of Artificial Sequence: Synthetic oligonucleotide for generating gRNA expression plasmid
acaccggtccagatgaacttcag

SEQ ID NO: 1158 - DNA, 23 bp, Artificial Sequence
  Description of Artificial Sequence: Synthetic oligonucleotide for generating gRNA expression plasmid
acaccggagcagatgaacttcag

SEQ ID NO: 1159 - DNA, 23 bp, Artificial Sequence
  Description of Artificial Sequence: Synthetic oligonucleotide for generating gRNA expression plasmid
acaccgctgcagatgaacttcag

SEQ ID NO: 1160 - DNA, 23 bp, Artificial Sequence
  Description of Artificial Sequence: Synthetic oligonucleotide for generating gRNA expression plasmid
acaccggtgcagatgaacttgtg

SEQ ID NO: 1161 - DNA, 23 bp, Artificial Sequence
  Description of Artificial Sequence: Synthetic oligonucleotide for generating gRNA expression plasmid
acaccggtgcagatgaacaacag

SEQ ID NO: 1162 - DNA, 23 bp, Artificial Sequence
  Description of Artificial Sequence: Synthetic oligonucleotide for generating gRNA expression plasmid
acaccggtgcagatgatgttcag

SEQ ID NO: 1163 - DNA, 23 bp, Artificial Sequence
  Description of Artificial Sequence: Synthetic oligonucleotide for generating gRNA expression plasmid
acaccggtgcagatctacttcag

SEQ ID NO: 1164 - DNA, 23 bp, Artificial Sequence
  Description of Artificial Sequence: Synthetic oligonucleotide for generating gRNA expression plasmid
acaccggtgcagtagaacttcag

SEQ ID NO: 1165 - DNA, 23 bp, Artificial Sequence
  Description of Artificial Sequence: Synthetic oligonucleotide for generating gRNA expression plasmid
acaccggtgctcatgaacttcag

SEQ ID NO: 1166 - DNA, 23 bp, Artificial Sequence
  Description of Artificial Sequence: Synthetic oligonucleotide for generating gRNA expression plasmid
acaccggtcgagatgaacttcag

SEQ ID NO: 1167 - DNA, 23 bp, Artificial Sequence
  Description of Artificial Sequence: Synthetic oligonucleotide for generating gRNA expression plasmid
acaccgcagcagatgaacttcag

SEQ ID NO: 1168 - DNA, 24 bp, Artificial Sequence
  Description of Artificial Sequence: Synthetic oligonucleotide for generating gRNA expression plasmid
acaccgtggggggagtttgctccg

SEQ ID NO: 1169 - DNA, 23 bp, Artificial Sequence
  Description of Artificial Sequence: Synthetic oligonucleotide for generating gRNA expression plasmid
acaccgagtgagtgtgtgcgtgg

SEQ ID NO: 1170 - DNA, 24 bp, Artificial Sequence
  Description of Artificial Sequence: Synthetic oligonucleotide for generating gRNA expression plasmid
acaccgtccgagcagaagaagaag

SEQ ID NO: 1171 - DNA, 26 bp, Artificial Sequence
  Description of Artificial Sequence: Synthetic oligonucleotide for generating gRNA expression plasmid
acaccgcagatgtagtgtttccacag

SEQ ID NO: 1172 - DNA, 23 bp, Artificial Sequence
  Description of Artificial Sequence: Synthetic oligonucleotide for generating gRNA expression plasmid
acaccgatgtagtgtttccacag

SEQ ID NO: 1173 - DNA, 26 bp, Artificial Sequence
  Description of Artificial Sequence: Synthetic oligonucleotide for generating gRNA expression plasmid
acacctccctctttagccagagccgg

SEQ ID NO: 1174 - DNA, 26 bp, Artificial Sequence
  Description of Artificial Sequence: Synthetic oligonucleotide for generating gRNA expression plasmid
acaccgccgtttgtactttgtcctcg

SEQ ID NO: 1175 - DNA, 23 bp, Artificial Sequence
  Description of Artificial Sequence: Synthetic oligonucleotide for generating gRNA expression plasmid
acaccgtttgtactttgtcctcg

SEQ ID NO: 1176 - DNA, 26 bp, Artificial Sequence
  Description of Artificial Sequence: Synthetic oligonucleotide for generating gRNA expression plasmid
acaccgggaagactgaggctacatag

SEQ ID NO: 1177 - DNA, 24 bp, Artificial Sequence
  Description of Artificial Sequence: Synthetic oligonucleotide for generating gRNA expression plasmid
acaccgaagactgaggctacatag

SEQ ID NO: 1178 - DNA, 26 bp, Artificial Sequence
  Description of Artificial Sequence: Synthetic oligonucleotide for generating gRNA expression plasmid
acaccgaggcccccagagcagccacg

SEQ ID NO: 1179 - DNA, 23 bp, Artificial Sequence
  Description of Artificial Sequence: Synthetic oligonucleotide for generating gRNA expression plasmid
acaccgcccccagagcagccacg

SEQ ID NO: 1180 - DNA, 24 bp, Artificial Sequence
  Description of Artificial Sequence: Synthetic oligonucleotide for generating gRNA expression plasmid
aaaacggggcaagctgcccgtgcg

SEQ ID NO: 1181 - DNA, 24 bp, Artificial Sequence
  Description of Artificial Sequence: Synthetic oligonucleotide for generating gRNA expression plasmid
aaaacgcggcaagctgcccgtgcg

SEQ ID NO: 1182 - DNA, 24 bp, Artificial Sequence
  Description of Artificial Sequence: Synthetic oligonucleotide for generating gRNA expression plasmid
aaaaccgggcaagctgcccgtgcg

SEQ ID NO: 1183 - DNA, 24 bp, Artificial Sequence
  Description of Artificial Sequence: Synthetic oligonucleotide for generating gRNA expression plasmid
aaaaccccgcaagctgcccgtgcg

SEQ ID NO: 1184 - DNA, 24 bp, Artificial Sequence
  Description of Artificial Sequence: Synthetic oligonucleotide for generating gRNA expression plasmid
aaaacccgccaagctgcccgtgcg

SEQ ID NO: 1185 - DNA, 24 bp, Artificial Sequence
  Description of Artificial Sequence: Synthetic oligonucleotide for generating gRNA expression plasmid
aaaacccgggaagctgcccgtgcg

SEQ ID NO: 1186 - DNA, 24 bp, Artificial Sequence
  Description of Artificial Sequence: Synthetic oligonucleotide for generating gRNA expression plasmid
aaaacccggctagctgcccgtgcg

SEQ ID NO: 1187 - DNA, 24 bp, Artificial Sequence
  Description of Artificial Sequence: Synthetic oligonucleotide for generating gRNA expression plasmid
aaaacccggcatgctgcccgtgcg

SEQ ID NO: 1188 - DNA, 24 bp, Artificial Sequence
  Description of Artificial Sequence: Synthetic oligonucleotide for generating gRNA expression plasmid
aaaacccggcaacctgcccgtgcg

SEQ ID NO: 1189 - DNA, 24 bp, Artificial Sequence
  Description of Artificial Sequence: Synthetic oligonucleotide for generating gRNA expression plasmid
aaaacccggcaaggtgcccgtgcg

SEQ ID NO: 1190 - DNA, 24 bp, Artificial Sequence
  Description of Artificial Sequence: Synthetic oligonucleotide for generating gRNA expression plasmid
aaaacccggcaagcagcccgtgcg

SEQ ID NO: 1191 - DNA, 24 bp, Artificial Sequence
  Description of Artificial Sequence: Synthetic oligonucleotide for generating gRNA expression plasmid
aaaacccggcaagctccccgtgcg

SEQ ID NO: 1192 - DNA, 24 bp, Artificial Sequence
  Description of Artificial Sequence: Synthetic oligonucleotide for generating gRNA expression plasmid
aaaacccggcaagctggccgtgcg

SEQ ID NO: 1193 - DNA, 24 bp, Artificial Sequence
  Description of Artificial Sequence: Synthetic oligonucleotide for generating gRNA expression plasmid
aaaacccggcaagctgcgcgtgcg

SEQ ID NO: 1194 - DNA, 24 bp, Artificial Sequence
  Description of Artificial Sequence: Synthetic oligonucleotide for generating gRNA expression plasmid
aaaacccggcaagctgccggtgcg

SEQ ID NO: 1195 - DNA, 24 bp, Artificial Sequence
  Description of Artificial Sequence: Synthetic oligonucleotide for generating gRNA expression plasmid
aaaacccggcaagctgcccctgcg

SEQ ID NO: 1196 - DNA, 24 bp, Artificial Sequence
  Description of Artificial Sequence: Synthetic oligonucleotide for generating gRNA expression plasmid
aaaacccggcaagctgcccgagcg

SEQ ID NO: 1197 - DNA, 24 bp, Artificial Sequence
  Description of Artificial Sequence: Synthetic oligonucleotide for generating gRNA expression plasmid
aaaacccggcaagctgcccgtccg

SEQ ID NO: 1198 - DNA, 24 bp, Artificial Sequence
  Description of Artificial Sequence: Synthetic oligonucleotide for generating gRNA expression plasmid
aaaacggggcaagctgcccgtgcg

SEQ ID NO: 1199 - DNA, 24 bp, Artificial Sequence
  Description of Artificial Sequence: Synthetic oligonucleotide for generating gRNA expression plasmid
aaaaccccccaagctgcccgtgcg

SEQ ID NO: 1200 - DNA, 24 bp, Artificial Sequence
  Description of Artificial Sequence: Synthetic oligonucleotide for generating gRNA expression plasmid
aaaacccgggtagctgcccgtgcg

SEQ ID NO: 1201 - DNA, 24 bp, Artificial Sequence
  Description of Artificial Sequence: Synthetic oligonucleotide for generating gRNA expression plasmid
aaaacccggcatcctgcccgtgcg

SEQ ID NO: 1202 - DNA, 24 bp, Artificial Sequence
  Description of Artificial Sequence: Synthetic oligonucleotide for generating gRNA expression plasmid
aaaacccggcaaggagcccgtgcg

SEQ ID NO: 1203 - DNA, 24 bp, Artificial Sequence
  Description of Artificial Sequence: Synthetic oligonucleotide for generating gRNA expression plasmid
aaaacccggcaagctcgccgtgcg

SEQ ID NO: 1204 - DNA, 24 bp, Artificial Sequence
  Description of Artificial Sequence: Synthetic oligonucleotide for generating gRNA expression plasmid
aaaacccggcaagctgcgggtgcg

SEQ ID NO: 1205 - DNA, 24 bp, Artificial Sequence
  Description of Artificial Sequence: Synthetic oligonucleotide for generating gRNA expression plasmid
aaaacccggcaagctgccccagcg

SEQ ID NO: 1206 - DNA, 24 bp, Artificial Sequence
  Description of Artificial Sequence: Synthetic oligonucleotide for generating gRNA expression plasmid
aaaacccggcaagctgcccgaccg

SEQ ID NO: 1207 - DNA, 23 bp, Artificial Sequence
  Description of Artificial Sequence: Synthetic oligonucleotide for generating gRNA expression plasmid
aaaacacaagcagaagaacggcg

SEQ ID NO: 1208 - DNA, 23 bp, Artificial Sequence
  Description of Artificial Sequence: Synthetic oligonucleotide for generating gRNA expression plasmid
aaaactcaagcagaagaacggcg

SEQ ID NO: 1209 - DNA, 23 bp, Artificial Sequence
  Description of Artificial Sequence: Synthetic oligonucleotide for generating gRNA expression plasmid
aaaacagaagcagaagaacggcg

SEQ ID NO: 1210 - DNA, 23 bp, Artificial Sequence
  Description of Artificial Sequence: Synthetic oligonucleotide for generating gRNA expression plasmid
aaaacactagcagaagaacggcg

SEQ ID NO: 1211 - DNA, 23 bp, Artificial Sequence
  Description of Artificial Sequence: Synthetic oligonucleotide for generating gRNA expression plasmid
aaaacacatgcagaagaacggcg

SEQ ID NO: 1212 - DNA, 23 bp, Artificial Sequence
  Description of Artificial Sequence: Synthetic oligonucleotide for generating gRNA expression plasmid
aaaacacaaccagaagaacggcg

SEQ ID NO: 1213 - DNA, 23 bp, Artificial Sequence
  Description of Artificial Sequence: Synthetic oligonucleotide for generating gRNA expression plasmid
aaaacacaaggagaagaacggcg

SEQ ID NO: 1214 - DNA, 23 bp, Artificial Sequence
  Description of Artificial Sequence: Synthetic oligonucleotide for generating gRNA expression plasmid
aaaacacaagctgaagaacggcg

SEQ ID NO: 1215 - DNA, 23 bp, Artificial Sequence
  Description of Artificial Sequence: Synthetic oligonucleotide for generating gRNA expression plasmid
aaaacacaagcacaagaacggcg

SEQ ID NO: 1216 - DNA, 23 bp, Artificial Sequence
  Description of Artificial Sequence: Synthetic oligonucleotide for generating gRNA expression plasmid
aaaacacaagcagtagaacggcg

SEQ ID NO: 1217 - DNA, 23 bp, Artificial Sequence
  Description of Artificial Sequence: Synthetic oligonucleotide for generating gRNA expression plasmid
aaaacacaagcagatgaacggcg

SEQ ID NO: 1218 - DNA, 23 bp, Artificial Sequence
  Description of Artificial Sequence: Synthetic oligonucleotide for generating gRNA expression plasmid
aaaacacaagcagaacaacggcg

SEQ ID NO: 1219 - DNA, 23 bp, Artificial Sequence
  Description of Artificial Sequence: Synthetic oligonucleotide for generating gRNA expression plasmid
aaaacacaagcagaagtacggcg

SEQ ID NO: 1220 - DNA, 23 bp, Artificial Sequence
  Description of Artificial Sequence: Synthetic oligonucleotide for generating gRNA expression plasmid
aaaacacaagcagaagatcggcg

SEQ ID NO: 1221 - DNA, 23 bp, Artificial Sequence
  Description of Artificial Sequence: Synthetic oligonucleotide for generating gRNA expression plasmid
aaaacacaagcagaagaagggcg

SEQ ID NO: 1222 - DNA, 23 bp, Artificial Sequence
  Description of Artificial Sequence: Synthetic oligonucleotide for generating gRNA expression plasmid
aaaacacaagcagaagaaccgcg

SEQ ID NO: 1223 - DNA, 23 bp, Artificial Sequence
  Description of Artificial Sequence: Synthetic oligonucleotide for generating gRNA expression plasmid
aaaacacaagcagaagaacgccg

SEQ ID NO: 1224 - DNA, 23 bp, Artificial Sequence
  Description of Artificial Sequence: Synthetic oligonucleotide for generating gRNA expression plasmid
aaaactgaagcagaagaacggcg

SEQ ID NO: 1225 - DNA, 23 bp, Artificial Sequence
  Description of Artificial Sequence: Synthetic oligonucleotide for generating gRNA expression plasmid
aaaacacttgcagaagaacggcg

SEQ ID NO: 1226 - DNA, 23 bp, Artificial Sequence
  Description of Artificial Sequence: Synthetic oligonucleotide for generating gRNA expression plasmid
aaaacacaacgagaagaacggcg

SEQ ID NO: 1227 - DNA, 23 bp, Artificial Sequence
  Description of Artificial Sequence: Synthetic oligonucleotide for generating gRNA expression plasmid
aaaacacaagctcaagaacggcg

SEQ ID NO: 1228 - DNA, 23 bp, Artificial Sequence
  Description of Artificial Sequence: Synthetic oligonucleotide for generating gRNA expression plasmid
aaaacacaagcagttgaacggcg

SEQ ID NO: 1229 - DNA, 23 bp, Artificial Sequence
  Description of Artificial Sequence: Synthetic oligonucleotide for generating gRNA expression plasmid
aaaacacaagcagaactacggcg

SEQ ID NO: 1230 - DNA, 23 bp, Artificial Sequence
  Description of Artificial Sequence: Synthetic oligonucleotide for generating gRNA expression plasmid
aaaacacaagcagaagatgggcg

SEQ ID NO: 1231 - DNA, 23 bp, Artificial Sequence
  Description of Artificial Sequence: Synthetic oligonucleotide for generating gRNA expression plasmid
aaaacacaagcagaagaaccccg

SEQ ID NO: 1232 - DNA, 23 bp, Artificial Sequence
  Description of Artificial Sequence: Synthetic oligonucleotide for generating gRNA expression plasmid
aaaactctagttcatctgcaccg

SEQ ID NO: 1233 - DNA, 23 bp, Artificial Sequence
  Description of Artificial Sequence: Synthetic oligonucleotide for generating gRNA expression plasmid
aaaactcaagttcatctgcaccg

SEQ ID NO: 1234 - DNA, 23 bp, Artificial Sequence
  Description of Artificial Sequence: Synthetic oligonucleotide for generating gRNA expression plasmid
aaaactgtagttcatctgcaccg

SEQ ID NO: 1235 - DNA, 23 bp, Artificial Sequence
  Description of Artificial Sequence: Synthetic oligonucleotide for generating gRNA expression plasmid
aaaactgatgttcatctgcaccg

SEQ ID NO: 1236 - DNA, 23 bp, Artificial Sequence
  Description of Artificial Sequence: Synthetic oligonucleotide for generating gRNA expression plasmid
aaaactgaacttcatctgcaccg

SEQ ID NO: 1237 - DNA, 23 bp, Artificial Sequence
  Description of Artificial Sequence: Synthetic oligonucleotide for generating gRNA expression plasmid
aaaactgaagatcatctgcaccg

SEQ ID NO: 1238 - DNA, 23 bp, Artificial Sequence
  Description of Artificial Sequence: Synthetic oligonucleotide for generating gRNA expression plasmid
aaaactgaagtacatctgcaccg

SEQ ID NO: 1239 - DNA, 23 bp, Artificial Sequence
  Description of Artificial Sequence: Synthetic oligonucleotide for generating gRNA expression plasmid
aaaactgaagttgatctgcaccg

SEQ ID NO: 1240 - DNA, 23 bp, Artificial Sequence
  Description of Artificial Sequence: Synthetic oligonucleotide for generating gRNA expression plasmid
aaaactgaagttcttctgcaccg

SEQ ID NO: 1241 - DNA, 23 bp, Artificial Sequence
  Description of Artificial Sequence: Synthetic oligonucleotide for generating gRNA expression plasmid
aaaactgaagttcaactgcaccg

SEQ ID NO: 1242 - DNA, 23 bp, Artificial Sequence
  Description of Artificial Sequence: Synthetic oligonucleotide for generating gRNA expression plasmid
aaaactgaagttcatgtgcaccg

SEQ ID NO: 1243 - DNA, 23 bp, Artificial Sequence
  Description of Artificial Sequence: Synthetic oligonucleotide for generating gRNA expression plasmid
aaaactgaagttcatcagcaccg

SEQ ID NO: 1244 - DNA, 23 bp, Artificial Sequence
  Description of Artificial Sequence: Synthetic oligonucleotide for generating gRNA expression plasmid
aaaactgaagttcatctccaccg

SEQ ID NO: 1245 - DNA, 23 bp, Artificial Sequence
  Description of Artificial Sequence: Synthetic oligonucleotide for generating gRNA expression plasmid
aaaactgaagttcatctggaccg

SEQ ID NO: 1246 - DNA, 23 bp, Artificial Sequence
  Description of Artificial Sequence: Synthetic oligonucleotide for generating gRNA expression plasmid
aaaactgaagttcatctgctccg

SEQ ID NO: 1247 - DNA, 23 bp, Artificial Sequence
  Description of Artificial Sequence: Synthetic oligonucleotide for generating gRNA expression plasmid
aaaactgaagttcatctgcagcg

SEQ ID NO: 1248 - DNA, 23 bp, Artificial Sequence
  Description of Artificial Sequence: Synthetic oligonucleotide for generating gRNA expression plasmid
aaaactgaagttcatctgcagcg

SEQ ID NO: 1249 - DNA, 23 bp, Artificial Sequence
  Description of Artificial Sequence: Synthetic oligonucleotide for generating gRNA expression plasmid
aaaacacaagttcatctgcaccg

SEQ ID NO: 1250 - DNA, 23 bp, Artificial Sequence
  Description of Artificial Sequence: Synthetic oligonucleotide for generating gRNA expression plasmid
aaaactgttgttcatctgcaccg

SEQ ID NO: 1251 - DNA, 23 bp, Artificial Sequence
  Description of Artificial Sequence: Synthetic oligonucleotide for generating gRNA expression plasmid
aaaactgaacatcatctgcaccg

SEQ ID NO: 1252 - DNA, 23 bp, Artificial Sequence
  Description of Artificial Sequence: Synthetic oligonucleotide for generating gRNA expression plasmid
aaaactgaagtagatctgcaccg

SEQ ID NO: 1253 - DNA, 23 bp, Artificial Sequence
  Description of Artificial Sequence: Synthetic oligonucleotide for generating gRNA expression plasmid
aaaactgaagttctactgcaccg

SEQ ID NO: 1254 - DNA, 23 bp, Artificial Sequence
  Description of Artificial Sequence: Synthetic oligonucleotide for generating gRNA expression plasmid
aaaactgaagttcatgagcaccg

SEQ ID NO: 1255 - DNA, 23 bp, Artificial Sequence
  Description of Artificial Sequence: Synthetic oligonucleotide for generating gRNA expression plasmid
aaaactgaagttcatctcgaccg

SEQ ID NO: 1256 - DNA, 23 bp, Artificial Sequence
  Description of Artificial Sequence: Synthetic oligonucleotide for generating gRNA expression plasmid
aaaactgaagttcatctgctgcg

SEQ ID NO: 1257 - DNA, 24 bp, Artificial Sequence
  Description of Artificial Sequence: Synthetic oligonucleotide for generating gRNA expression plasmid
aaaacggagcaaactccccccacg

SEQ ID NO: 1258 - DNA, 23 bp, Artificial Sequence
  Description of Artificial Sequence: Synthetic oligonucleotide for generating gRNA expression plasmid
aaaaccacgcacacactcactcg

SEQ ID NO: 1259 - DNA, 24 bp, Artificial Sequence
  Description of Artificial Sequence: Synthetic oligonucleotide for generating gRNA expression plasmid
aaaacttcttcttctgctcggacg

SEQ ID NO: 1260 - DNA, 26 bp, Artificial Sequence
  Description of Artificial Sequence: Synthetic oligonucleotide for generating gRNA expression plasmid
aaaactgtggaaacactacatctgcg

SEQ ID NO: 1261 - DNA, 23 bp, Artificial Sequence
  Description of Artificial Sequence: Synthetic oligonucleotide for generating gRNA expression plasmid
aaaactgtggaaacactacatcg

SEQ ID NO: 1262 - DNA, 26 bp, Artificial Sequence
  Description of Artificial Sequence: Synthetic oligonucleotide for generating gRNA expression plasmid
aaaaccggctctggctaaagagggag

SEQ ID NO: 1263 - DNA, 26 bp, Artificial Sequence
  Description of Artificial Sequence: Synthetic oligonucleotide for generating gRNA expression plasmid
aaaacgaggacaaagtacaaacggcg

SEQ ID NO: 1264 - DNA, 23 bp, Artificial Sequence
  Description of Artificial Sequence: Synthetic oligonucleotide for generating gRNA expression plasmid
aaaacgaggacaaagtacaaacg

SEQ ID NO: 1265 - DNA, 26 bp, Artificial Sequence
  Description of Artificial Sequence: Synthetic oligonucleotide for generating gRNA expression plasmid
aaaactatgtagcctcagtcttcccg

SEQ ID NO: 1266 - DNA, 24 bp, Artificial Sequence
  Description of Artificial Sequence: Synthetic oligonucleotide for generating gRNA expression plasmid
aaaactatgtagcctcagtcttcg

SEQ ID NO: 1267 - DNA, 26 bp, Artificial Sequence
  Description of Artificial Sequence: Synthetic oligonucleotide for generating gRNA expression plasmid
aaaacgtggctgctctgggggcctcg

SEQ ID NO: 1268 - DNA, 23 bp, Artificial Sequence
  Description of Artificial Sequence: Synthetic oligonucleotide for generating gRNA expression plasmid
aaaacgtggctgctctgggggcg

SEQ ID NO: 1269 - DNA, 23 bp, Artificial Sequence
  Description of Artificial Sequence: Synthetic expected off-target sequence
gggtggggggagtttgctcctgg

SEQ ID NO: 1270 - DNA, 20 bp, Artificial Sequence
  Description of Artificial Sequence: Synthetic PCR primer
tccagatggcacattgtcag

SEQ ID NO: 1271 - DNA, 20 bp, Artificial Sequence
  Description of Artificial Sequence: Synthetic PCR primer
agggagcaggaaagtgaggt

SEQ ID NO: 1272 - DNA, 23 bp, Artificial Sequence
  Description of Artificial Sequence: Synthetic expected off-target sequence
gggtggggggagtttgccccagg

SEQ ID NO: 1273 - DNA, 20 bp, Artificial Sequence
  Description of Artificial Sequence: Synthetic PCR primer
ggggcccactcttcttccat

SEQ ID NO: 1274 - DNA, 20 bp, Artificial Sequence
  Description of Artificial Sequence: Synthetic PCR primer
acccagactcctggtgtggc

SEQ ID NO: 1275 - DNA, 23 bp, Artificial Sequence
  Description of Artificial Sequence: Synthetic expected off-target sequence
gcgtggggggtgtttgctcccgg

SEQ ID NO: 1276 - DNA, 22 bp, Artificial Sequence
  Description of Artificial Sequence: Synthetic PCR primer
gctaagcagagatgcctatgcc

SEQ ID NO: 1277 - DNA, 20 bp, Artificial Sequence
  Description of Artificial Sequence: Synthetic PCR primer
accaccctttcccccagaaa

SEQ ID NO: 1278 - DNA, 23 bp, Artificial Sequence
  Description of Artificial Sequence: Synthetic expected off-target sequence
ggatggagggagtttgctcctgg

SEQ ID NO: 1279 - DNA, 20 bp, Artificial Sequence
  Description of Artificial Sequence: Synthetic PCR primer
accccacagccaggttttca

SEQ ID NO: 1280 - DNA, 21 bp, Artificial Sequence
  Description of Artificial Sequence: Synthetic PCR primer
gaatcactgcacctggccatc

SEQ ID NO: 1281 - DNA, 23 bp, Artificial Sequence
  Description of Artificial Sequence: Synthetic expected off-target sequence
gggagggtggagtttgctcctgg

SEQ ID NO: 1282 - DNA, 20 bp, Artificial Sequence
  Description of Artificial Sequence: Synthetic PCR primer
tgcggcaacttcagacaacc

SEQ ID NO: 1283 - DNA, 20 bp, Artificial Sequence
  Description of Artificial Sequence: Synthetic PCR primer
taaagggcgtgctgggagag

SEQ ID NO: 1284 - DNA, 23 bp, Artificial Sequence
  Description of Artificial Sequence: Synthetic expected off-target sequence
gggtgggtggagtttgctactgg

SEQ ID NO: 1285 - DNA, 20 bp, Artificial Sequence
  Description of Artificial Sequence: Synthetic PCR primer
gcatgtcaggatctgacccc

SEQ ID NO: 1286 - DNA, 20 bp, Artificial Sequence
  Description of Artificial Sequence: Synthetic PCR primer
tgcagggccatcttgtgtgt

SEQ ID NO: 1287 - DNA, 23 bp, Artificial Sequence
  Description of Artificial Sequence: Synthetic expected off-target sequence
cgggggagggagtttgctcctgg

SEQ ID NO: 1288 - DNA, 20 bp, Artificial Sequence
  Description of Artificial Sequence: Synthetic PCR primer
ccaccacatgttctgggtgc

SEQ ID NO: 1289 - DNA, 20 bp, Artificial Sequence
  Description of Artificial Sequence: Synthetic PCR primer
ctgggtctgttccctgtggg

SEQ ID NO: 1290 - DNA, 23 bp, Artificial Sequence
  Description of Artificial Sequence: Synthetic expected off-target sequence
gagtgggtggagtttgctacagg

SEQ ID NO: 1291 - DNA, 20 bp, Artificial Sequence
  Description of Artificial Sequence: Synthetic PCR primer
ggctctccctgccctagttt

SEQ ID NO: 1292 - DNA, 20 bp, Artificial Sequence
  Description of Artificial Sequence: Synthetic PCR primer
gcaggtcaagttggaacccg

SEQ ID NO: 1293 - DNA, 23 bp, Artificial Sequence
  Description of Artificial Sequence: Synthetic expected off-target sequence
gggaggggagagtttgttccagg

SEQ ID NO: 1294 - DNA, 24 bp, Artificial Sequence
  Description of Artificial Sequence: Synthetic PCR primer
ggggctgagaacacatgagatgca

SEQ ID NO: 1295 - DNA, 21 bp, Artificial Sequence
  Description of Artificial Sequence: Synthetic PCR primer
agatttgtgcactgcctgcct

SEQ ID NO: 1296 - DNA, 23 bp, Artificial Sequence
  Description of Artificial Sequence: Synthetic expected off-target sequence
gggagggggcaggttgctccagg

SEQ ID NO: 1297 - DNA, 20 bp, Artificial Sequence
  Description of Artificial Sequence: Synthetic PCR primer
cccgacctccgctccaaagc

SEQ ID NO: 1298 - DNA, 20 bp, Artificial Sequence
  Description of Artificial Sequence: Synthetic PCR primer
ggacctctgcacaccctggc

SEQ ID NO: 1299 - DNA, 23 bp, Artificial Sequence
  Description of Artificial Sequence: Synthetic expected off-target sequence
gggaggggggagtgtgttccggg

SEQ ID NO: 1300 - DNA, 20 bp, Artificial Sequence
  Description of Artificial Sequence: Synthetic PCR primer
tgcaaggtcgcatagtccca

SEQ ID NO: 1301 - DNA, 20 bp, Artificial Sequence
  Description of Artificial Sequence: Synthetic PCR primer
caggagggggaagtgtgtcc

SEQ ID NO: 1302 - DNA, 23 bp, Artificial Sequence
  Description of Artificial Sequence: Synthetic expected off-target sequence
ggggaggggaagtttgctcctgg

SEQ ID NO: 1303 - DNA, 21 bp, Artificial Sequence
  Description of Artificial Sequence: Synthetic PCR primer
gcccattctttttgcagtgga

SEQ ID NO: 1304 - DNA, 22 bp, Artificial Sequence
  Description of Artificial Sequence: Synthetic PCR primer
gagagcaagtttgttccccagg

SEQ ID NO: 1305 - DNA, 23 bp, Artificial Sequence
  Description of Artificial Sequence: Synthetic expected off-target sequence
gggggtggggactttgctccagg

SEQ ID NO: 1306 - DNA, 20 bp, Artificial Sequence
  Description of Artificial Sequence: Synthetic PCR primer
gcccccagcccctctgtttc

SEQ ID NO: 1307 - DNA, 20 bp, Artificial Sequence
  Description of Artificial Sequence: Synthetic PCR primer
gctgctggtaggggagctgg

SEQ ID NO: 1308 - DNA, 23 bp, Artificial Sequence
  Description of Artificial Sequence: Synthetic expected off-target sequence
gggtcgggggagtgggctccagg

SEQ ID NO: 1309 - DNA, 20 bp, Artificial Sequence
  Description of Artificial Sequence: Synthetic PCR primer
cggctgccttccctgagtcc

SEQ ID NO: 1310 - DNA, 20 bp, Artificial Sequence
  Description of Artificial Sequence: Synthetic PCR primer
gggtgacgcttgccatgagc

SEQ ID NO: 1311 - DNA, 23 bp, Artificial Sequence
  Description of Artificial Sequence: Synthetic expected off-target sequence
gggtggctggagtttgctgctgg

SEQ ID NO: 1312 - DNA, 26 bp, Artificial Sequence
  Description of Artificial Sequence: Synthetic PCR primer
tgaccctggagtacaaaatgttccca

SEQ ID NO: 1313 - DNA, 21 bp, Artificial Sequence
  Description of Artificial Sequence: Synthetic PCR primer
gctgagacaaccagcccagct

SEQ ID NO: 1314 - DNA, 23 bp, Artificial Sequence
  Description of Artificial Sequence: Synthetic expected off-target sequence
gggtggggggtgcctgctccagg

SEQ ID NO: 1315 - DNA, 20 bp, Artificial Sequence
  Description of Artificial Sequence: Synthetic PCR primer
tgcctccacccttagcccct

SEQ ID NO: 1316 - DNA, 20 bp, Artificial Sequence
  Description of Artificial Sequence: Synthetic PCR primer
gcagccgatccacactgggg

SEQ ID NO: 1317 - DNA, 23 bp, Artificial Sequence
  Description of Artificial Sequence: Synthetic expected off-target sequence
ggttgaggggagtctgctccagg

SEQ ID NO: 1318 - DNA, 22 bp, Artificial Sequence
  Description of Artificial Sequence: Synthetic PCR primer
aactcaggacaacactgcctgt

SEQ ID NO: 1319 - DNA, 21 bp, Artificial Sequence
  Description of Artificial Sequence: Synthetic PCR primer
cccaggagcagggtacaatgc

SEQ ID NO: 1320 - DNA, 23 bp, Artificial Sequence
  Description of Artificial Sequence: Synthetic expected off-target sequence
gtgtgggtggcgtttgctccagg

SEQ ID NO: 1321 - DNA, 20 bp, Artificial Sequence
  Description of Artificial Sequence: Synthetic PCR primer
tcctccttggagaggggccc

SEQ ID NO: 1322 - DNA, 21 bp, Artificial Sequence
  Description of Artificial Sequence: Synthetic PCR primer
ccttggaaggggccttggtgg

SEQ ID NO: 1323 - DNA, 23 bp, Artificial Sequence
  Description of Artificial Sequence: Synthetic expected off-target sequence
aggtggtgggagcttgttcctgg

SEQ ID NO: 1324 - DNA, 20 bp, Artificial Sequence
  Description of Artificial Sequence: Synthetic PCR primer
ccgagggcatgggcaatcct

SEQ ID NO: 1325 - DNA, 20 bp, Artificial Sequence
  Description of Artificial Sequence: Synthetic PCR primer
ggctgctgcgagttgccaac

SEQ ID NO: 1326 - DNA, 23 bp, Artificial Sequence
  Description of Artificial Sequence: Synthetic expected off-target sequence
agtttgggggagtttgccccagg

SEQ ID NO: 1327 - DNA, 23 bp, Artificial Sequence
  Description of Artificial Sequence: Synthetic PCR primer
tgctttgcatggggtctcagaca

SEQ ID NO: 1328 - DNA, 20 bp, Artificial Sequence
  Description of Artificial Sequence: Synthetic PCR primer
gggttgcttgccctctgtgt

SEQ ID NO: 1329 - DNA, 23 bp, Artificial Sequence
  Description of Artificial Sequence: Synthetic expected off-target sequence
atgtgtggggaatttgctccagg

SEQ ID NO: 1330 - DNA, 27 bp, Artificial Sequence
  Description of Artificial Sequence: Synthetic PCR primer
agctccttctcatttctcttctgctgt

SEQ ID NO: 1331 - DNA, 22 bp, Artificial Sequence
  Description of Artificial Sequence: Synthetic PCR primer
cacagaaggatgtgtgcaggtt

SEQ ID NO: 1332 - DNA, 23 bp, Artificial Sequence
  Description of Artificial Sequence: Synthetic expected off-target sequence
cagtggggggagctttctcctgg

SEQ ID NO: 1333 - DNA, 23 bp, Artificial Sequence
  Description of Artificial Sequence: Synthetic PCR primer
agcagacacaggtgaatgctgct

SEQ ID NO: 1334 - DNA, 21 bp, Artificial Sequence
  Description of Artificial Sequence: Synthetic PCR primer
ggtcaggtgtgctgctaggca

SEQ ID NO: 1335 - DNA, 23 bp, Artificial Sequence
  Description of Artificial Sequence: Synthetic expected off-target sequence
gagggggagcagtttgctccagg

SEQ ID NO: 1336 - DNA, 20 bp, Artificial Sequence
  Description of Artificial Sequence: Synthetic PCR primer
cctgtggggctctcaggtgc

SEQ ID NO: 1337 - DNA, 21 bp, Artificial Sequence
  Description of Artificial Sequence: Synthetic PCR primer
actgcctgccaaagtgggtgt

SEQ ID NO: 1338 - DNA, 23 bp, Artificial Sequence
  Description of Artificial Sequence: Synthetic expected off-target sequence
ggaggaggggagtctgctccagg

SEQ ID NO: 1339 - DNA, 20 bp, Artificial Sequence
  Description of Artificial Sequence: Synthetic PCR primer
agctgcactggggaatgagt

SEQ ID NO: 1340 - DNA, 20 bp, Artificial Sequence
  Description of Artificial Sequence: Synthetic PCR primer
tgccgggtaatagctggctt

SEQ ID NO: 1341 - DNA, 23 bp, Artificial Sequence
  Description of Artificial Sequence: Synthetic expected off-target sequence
ggagggggggcttttgctccagg

SEQ ID NO: 1342 - DNA, 20 bp, Artificial Sequence
  Description of Artificial Sequence: Synthetic PCR primer
ccagcctgggcaacaaagcg

SEQ ID NO: 1343 - DNA, 20 bp, Artificial Sequence
  Description of Artificial Sequence: Synthetic PCR primer
gggggcttccaggtcacagg

SEQ ID NO: 1344 - DNA, 23 bp, Artificial Sequence
  Description of Artificial Sequence: Synthetic expected off-target sequence
gggcaaggggaggttgctcctgg

SEQ ID NO: 1345 - DNA, 20 bp, Artificial Sequence
  Description of Artificial Sequence: Synthetic PCR primer
tacccccactgccccattgc

SEQ ID NO: 1346 - DNA, 23 bp, Artificial Sequence
  Description of Artificial Sequence: Synthetic PCR primer
acaggtccatgcttagcagaggg

SEQ ID NO: 1347 - DNA, 23 bp, Artificial Sequence
  Description of Artificial Sequence: Synthetic expected off-target sequence
gggtgattgaagtttgctccagg

SEQ ID NO: 1348 - DNA, 21 bp, Artificial Sequence
  Description of Artificial Sequence: Synthetic PCR primer
acggattcacgacggaggtgc

SEQ ID NO: 1349 - DNA, 20 bp, Artificial Sequence
  Description of Artificial Sequence: Synthetic PCR primer
ccgagtccgtggcagagagc

SEQ ID NO: 1350 - DNA, 23 bp, Artificial Sequence
  Description of Artificial Sequence: Synthetic expected off-target sequence
gggtgtggggtcattgctccagg

SEQ ID NO: 1351 - DNA, 23 bp, Artificial Sequence
  Description of Artificial Sequence: Synthetic PCR primer
tgtggttgaagtaggggacaggt

SEQ ID NO: 1352 - DNA, 24 bp, Artificial Sequence
  Description of Artificial Sequence: Synthetic PCR primer
tggcccaattggaagtgatttcgt

SEQ ID NO: 1353 - DNA, 23 bp, Artificial Sequence
  Description of Artificial Sequence: Synthetic expected off-target sequence
ggtgggggtgggtttgctcctgg

SEQ ID NO: 1354 - DNA, 23 bp, Artificial Sequence
  Description of Artificial Sequence: Synthetic PCR primer
tgggatggcagagtcatcaacgt

SEQ ID NO: 1355 - DNA, 22 bp, Artificial Sequence
  Description of Artificial Sequence: Synthetic PCR primer
ggcccaatcggtagaggatgca

SEQ ID NO: 1356 - DNA, 23 bp, Artificial Sequence
  Description of Artificial Sequence: Synthetic expected off-target sequence
gtgggggtagagtttgctccagg

SEQ ID NO: 1357 - DNA, 20 bp, Artificial Sequence
  Description of Artificial Sequence: Synthetic PCR primer
atggggcgctccagtctgtg

SEQ ID NO: 1358 - DNA, 20 bp, Artificial Sequence
  Description of Artificial Sequence: Synthetic PCR primer
tgcacccacacagccagcaa

SEQ ID NO: 1359 - DNA, 23 bp, Artificial Sequence
  Description of Artificial Sequence: Synthetic expected off-target sequence
tagtggagggagcttgctcctgg

SEQ ID NO: 1360 - DNA, 20 bp, Artificial Sequence
  Description of Artificial Sequence: Synthetic PCR primer
ggggagggaggaccagggaa

SEQ ID NO: 1361 - DNA, 20 bp, Artificial Sequence
  Description of Artificial Sequence: Synthetic PCR primer
aattagctgggcgcggtggt

SEQ ID NO: 1362 - DNA, 23 bp, Artificial Sequence
  Description of Artificial Sequence: Synthetic expected off-target sequence
tgctcgggggagtttgcaccagg

SEQ ID NO: 1363 - DNA, 20 bp, Artificial Sequence
  Description of Artificial Sequence: Synthetic PCR primer
atcccgtgcaggaagtcgcc

SEQ ID NO: 1364 - DNA, 20 bp, Artificial Sequence
  Description of Artificial Sequence: Synthetic PCR primer
caggcggccccttgaggaat

SEQ ID NO: 1365 - DNA, 23 bp, Artificial Sequence
  Description of Artificial Sequence: Synthetic expected off-target sequence
tggagaggggagttggctcctgg

SEQ ID NO: 1366 - DNA, 20 bp, Artificial Sequence
  Description of Artificial Sequence: Synthetic PCR primer
ccccaaccctttgctcagcg

SEQ ID NO: 1367 - DNA, 22 bp, Artificial Sequence
  Description of Artificial Sequence: Synthetic PCR primer
tgaggagaacaccacaggcaga

SEQ ID NO: 1368 - DNA, 23 bp, Artificial Sequence
  Description of Artificial Sequence: Synthetic expected off-target sequence
tggtgttgggagtctgctccagg

SEQ ID NO: 1369 - DNA, 20 bp, Artificial Sequence
  Description of Artificial Sequence: Synthetic PCR primer
atcgacgaggagggggcctt

SEQ ID NO: 1370 - DNA, 20 bp, Artificial Sequence
  Description of Artificial Sequence: Synthetic PCR primer
cccctcactcaagcaggccc

SEQ ID NO: 1371 - DNA, 23 bp, Artificial Sequence
  Description of Artificial Sequence: Synthetic expected off-target sequence
ttgggggggcagtttgctcctgg

SEQ ID NO: 1372 - DNA, 20 bp, Artificial Sequence
  Description of Artificial Sequence: Synthetic PCR primer
tgctcaaggggcctgttcca

SEQ ID NO: 1373 - DNA, 20 bp, Artificial Sequence
  Description of Artificial Sequence: Synthetic PCR primer
caggggcagtggcaggagtc

SEQ ID NO: 1374 - DNA, 23 bp, Artificial Sequence
  Description of Artificial Sequence: Synthetic expected off-target sequence
aagtaagggaagtttgctcctgg

SEQ ID NO: 1375 - DNA, 20 bp, Artificial Sequence
  Description of Artificial Sequence: Synthetic PCR primer
tgcctggcacgcagtaggtg

SEQ ID NO: 1376 - DNA, 20 bp, Artificial Sequence
  Description of Artificial Sequence: Synthetic PCR primer
gggaagggggaacaggtgca

SEQ ID NO: 1377 - DNA, 23 bp, Artificial Sequence
  Description of Artificial Sequence: Synthetic expected off-target sequence
agaagaggggattttgctcctgg

SEQ ID NO: 1378 - DNA, 23 bp, Artificial Sequence
  Description of Artificial Sequence: Synthetic expected off-target sequence
atctggggtgattttgctcctgg

SEQ ID NO: 1379 - DNA, 20 bp, Artificial Sequence
  Description of Artificial Sequence: Synthetic PCR primer
acctgggcttgccactaggg

SEQ ID NO: 1380 - DNA, 21 bp, Artificial Sequence
  Description of Artificial Sequence: Synthetic PCR primer
gctgctcgcagttaagcacca

SEQ ID NO: 1381 - DNA, 23 bp, Artificial Sequence
  Description of Artificial Sequence: Synthetic expected off-target sequence
ctctgctgggagtttgctcctgg

SEQ ID NO: 1382 - DNA, 20 bp, Artificial Sequence
  Description of Artificial Sequence: Synthetic PCR primer
gtggccgggctactgctacc

SEQ ID NO: 1383 - DNA, 20 bp, Artificial Sequence
  Description of Artificial Sequence: Synthetic PCR primer
ggttccacaagctgggggca

SEQ ID NO: 1384 - DNA, 23 bp, Artificial Sequence
  Description of Artificial Sequence: Synthetic expected off-target sequence
ctggtgggggagcttgctccagg

SEQ ID NO: 1385 - DNA, 23 bp, Artificial Sequence
  Description of Artificial Sequence: Synthetic expected off-target sequence
ctttcgggggagtttgcgccggg

SEQ ID NO: 1386 - DNA, 20 bp, Artificial Sequence
  Description of Artificial Sequence: Synthetic PCR primer
gcaagaggcggaggagaccc

SEQ ID NO: 1387 - DNA, 23 bp, Artificial Sequence
  Description of Artificial Sequence: Synthetic PCR primer
agagtcatccatttcctgggggc

SEQ ID NO: 1388 - DNA, 23 bp, Artificial Sequence
  Description of Artificial Sequence: Synthetic expected off-target sequence
ctttggggttagtttgctcctgg

SEQ ID NO: 1389 - DNA, 23 bp, Artificial Sequence
  Description of Artificial Sequence: Synthetic PCR primer
ggggtcagtggtgatatccccct

SEQ ID NO: 1390 - DNA, 27 bp, Artificial Sequence
  Description of Artificial Sequence: Synthetic PCR primer
agggaatcctttttccattgcttgttt

SEQ ID NO: 1391 - DNA, 23 bp, Artificial Sequence
  Description of Artificial Sequence: Synthetic expected off-target sequence
gctctggggtagtttgctccagg

SEQ ID NO: 1392 - DNA, 20 bp, Artificial Sequence
  Description of Artificial Sequence: Synthetic PCR primer
agagaggccacgtggagggt

SEQ ID NO: 1393 - DNA, 20 bp, Artificial Sequence
  Description of Artificial Sequence: Synthetic PCR primer
gcctcccctcctccttccca

SEQ ID NO: 1394 - DNA, 23 bp, Artificial Sequence
  Description of Artificial Sequence: Synthetic expected off-target sequence
gtctctcgggagtttgctccggg

SEQ ID NO: 1395 - DNA, 20 bp, Artificial Sequence
  Description of Artificial Sequence: Synthetic PCR primer
gacagtgccttgcgatgcac

SEQ ID NO: 1396 - DNA, 20 bp, Artificial Sequence
  Description of Artificial Sequence: Synthetic PCR primer
tctgaccggtatgcctgacg

SEQ ID NO: 1397 - DNA, 23 bp, Artificial Sequence
  Description of Artificial Sequence: Synthetic expected off-target sequence
tcctgagggcagtttgctccagg

SEQ ID NO: 1398 - DNA, 20 bp, Artificial Sequence
  Description of Artificial Sequence: Synthetic PCR primer
tgtgtgaacgcagcctggct

SEQ ID NO: 1399 - DNA, 24 bp, Artificial Sequence
  Description of Artificial Sequence: Synthetic PCR primer
tggtctagtacttcctccagcctt

SEQ ID NO: 1400 - DNA, 23 bp, Artificial Sequence
  Description of Artificial Sequence: Synthetic expected off-target sequence
tctttgggagagtttgctccagg

SEQ ID NO: 1401 - DNA, 22 bp, Artificial Sequence
  Description of Artificial Sequence: Synthetic PCR primer
ggttctcccttggctcctgtga

SEQ ID NO: 1402 - DNA, 20 bp, Artificial Sequence
  Description of Artificial Sequence: Synthetic PCR primer
cccactgctcctagccctgc

SEQ ID NO: 1403 - DNA, 23 bp, Artificial Sequence
  Description of Artificial Sequence: Synthetic expected off-target sequence
acaactggggagtttgctcctgg

SEQ ID NO: 1404 - DNA, 27 bp, Artificial Sequence
  Description of Artificial Sequence: Synthetic PCR primer
tgaagtcaacaatctaagcttccacct

SEQ ID NO: 1405 - DNA, 27 bp, Artificial Sequence
  Description of Artificial Sequence: Synthetic PCR primer
agctttggtagttggagtctttgaagg

SEQ ID NO: 1406 - DNA, 23 bp, Artificial Sequence
  Description of Artificial Sequence: Synthetic expected off-target sequence
acaaggtggaagtttgctcctgg

SEQ ID NO: 1407 - DNA, 24 bp, Artificial Sequence
  Description of Artificial Sequence: Synthetic PCR primer
tgattgggctgcagttcatgtaca

SEQ ID NO: 1408 - DNA, 20 bp, Artificial Sequence
  Description of Artificial Sequence: Synthetic PCR primer
gcacagcctgcccttggaag

SEQ ID NO: 1409 - DNA, 23 bp, Artificial Sequence
  Description of Artificial Sequence: Synthetic expected off-target sequence
acatagaaggagtttgctccagg

SEQ ID NO: 1410 - DNA, 21 bp, Artificial Sequence
  Description of Artificial Sequence: Synthetic PCR primer
tccatgggcccctctgaaaga

SEQ ID NO: 1411 - DNA, 20 bp, Artificial Sequence
  Description of Artificial Sequence: Synthetic PCR primer
agcggcttctgcttctgcga

SEQ ID NO: 1412 - DNA, 23 bp, Artificial Sequence
  Description of Artificial Sequence: Synthetic expected off-target sequence
agacccagggagtttgctcccgg

SEQ ID NO: 1413 - DNA, 20 bp, Artificial Sequence
  Description of Artificial Sequence: Synthetic PCR primer
gcggttggtggggttgatgc

SEQ ID NO: 1414 - DNA, 20 bp, Artificial Sequence
  Description of Artificial Sequence: Synthetic PCR primer
gagttcctcctcccgccagt

SEQ ID NO: 1415 - DNA, 23 bp, Artificial Sequence
  Description of Artificial Sequence: Synthetic expected off-target sequence
agacccagggagtttgctcccgg

SEQ ID NO: 1416 - DNA, 25 bp, Artificial Sequence
  Description of Artificial Sequence: Synthetic PCR primer
aggcaagattttccagtgtgcaaga

SEQ ID NO: 1417 - DNA, 20 bp, Artificial Sequence
  Description of Artificial Sequence: Synthetic PCR primer
gcttttgcctgggactccgc

SEQ ID NO: 1418 - DNA, 23 bp, Artificial Sequence
  Description of Artificial Sequence: Synthetic expected off-target sequence
cacggaggggtgtttgctcctgg

SEQ ID NO: 1419 - DNA, 20 bp, Artificial Sequence
  Description of Artificial Sequence: Synthetic PCR primer
gctgctggtcgggctctctg

SEQ ID NO: 1420 - DNA, 21 bp, Artificial Sequence
  Description of Artificial Sequence: Synthetic PCR primer
gctctgtcccacttcccctgg

SEQ ID NO: 1421 - DNA, 23 bp, Artificial Sequence
  Description of Artificial Sequence: Synthetic expected off-target sequence
cagagcttggagtttgctccagg

SEQ ID NO: 1422 - DNA, 20 bp, Artificial Sequence
  Description of Artificial Sequence: Synthetic PCR primer
gctgcgaggcttccgtgaga

SEQ ID NO: 1423 - DNA, 21 bp, Artificial Sequence
  Description of Artificial Sequence: Synthetic PCR primer
cgcccctagagctaagggggt

SEQ ID NO: 1424 - DNA, 23 bp, Artificial Sequence
  Description of Artificial Sequence: Synthetic expected off-target sequence
ctattgatggagtttgctcctgg

SEQ ID NO: 1425 - DNA, 20 bp, Artificial Sequence
  Description of Artificial Sequence: Synthetic PCR primer
ccaggagcctgagagctgcc

SEQ ID NO: 1426 - DNA, 21 bp, Artificial Sequence
  Description of Artificial Sequence: Synthetic PCR primer
agggctaggactgcagtgagc

SEQ ID NO: 1427 - DNA, 23 bp, Artificial Sequence
  Description of Artificial Sequence: Synthetic expected off-target sequence
ctttctagggagtttgctcctgg

SEQ ID NO: 1428 - DNA, 20 bp, Artificial Sequence
  Description of Artificial Sequence: Synthetic PCR primer
ctgtgctcagcctgggtgct

SEQ ID NO: 1429 - DNA, 21 bp, Artificial Sequence
  Description of Artificial Sequence: Synthetic PCR primer
gcctggggctgtgagtagttt

SEQ ID NO: 1430 - DNA, 23 bp, Artificial Sequence
  Description of Artificial Sequence: Synthetic expected off-target sequence
gccatgctggagtttgctccagg

SEQ ID NO: 1431 - DNA, 20 bp, Artificial Sequence
  Description of Artificial Sequence: Synthetic PCR primer
agctcgcgccagatctgtgg

SEQ ID NO: 1432 - DNA, 20 bp, Artificial Sequence
  Description of Artificial Sequence: Synthetic PCR primer
acttggcaggctgaggcagg

SEQ ID NO: 1433-1435 - skipped (3 entries)

SEQ ID NO: 1436 - DNA, 23 bp, Artificial Sequence
  Description of Artificial Sequence: Synthetic expected off-target sequence
gaccccctccaccccgcctccgg

SEQ ID NO: 1437 - DNA, 22 bp, Artificial Sequence
  Description of Artificial Sequence: Synthetic PCR primer
agagaagtcgaggaagagagag

SEQ ID NO: 1438 - DNA, 22 bp, Artificial Sequence
  Description of Artificial Sequence: Synthetic PCR primer
cagcagaaagttcatggtttcg

SEQ ID NO: 1439 - DNA, 23 bp, Artificial Sequence
  Description of Artificial Sequence: Synthetic expected off-target sequence
gaccccccccaccccgcccccgg

SEQ ID NO: 1440 - DNA, 22 bp, Artificial Sequence
  Description of Artificial Sequence: Synthetic PCR primer
tggacagctgcagtactccctg

SEQ ID NO: 1441 - DNA, 24 bp, Artificial Sequence
  Description of Artificial Sequence: Synthetic PCR primer
actgatcgatgatggcctatgggt

SEQ ID NO: 1442 - DNA, 23 bp, Artificial Sequence
  Description of Artificial Sequence: Synthetic expected off-target sequence
gggcccctccaccccgcctctgg

SEQ ID NO: 1443 - DNA, 20 bp, Artificial Sequence
  Description of Artificial Sequence: Synthetic PCR primer
caagatgtgcacttgggcta

SEQ ID NO: 1444 - DNA, 20 bp, Artificial Sequence
  Description of Artificial Sequence: Synthetic PCR primer
gcagcctattgtctcctggt

SEQ ID NO: 1445 - DNA, 23 bp, Artificial Sequence
  Description of Artificial Sequence: Synthetic expected off-target sequence
aaccccatccacccggcctcagg

SEQ ID NO: 1446 - DNA, 20 bp, Artificial Sequence
  Description of Artificial Sequence: Synthetic PCR primer
gtccagtgcctgaccctggc

SEQ ID NO: 1447 - DNA, 21 bp, Artificial Sequence
  Description of Artificial Sequence: Synthetic PCR primer
agcatcatgcctccagcttca

SEQ ID NO: 1448 - DNA, 23 bp, Artificial Sequence
  Description of Artificial Sequence: Synthetic expected off-target sequence
caccccctcaacaccgcctcagg

SEQ ID NO: 1449 - DNA, 20 bp, Artificial Sequence
  Description of Artificial Sequence: Synthetic PCR primer
gctcccgatcctctgccacc

SEQ ID NO: 1450 - DNA, 20 bp, Artificial Sequence
  Description of Artificial Sequence: Synthetic PCR primer
gcagctcccaccaccctcag

SEQ ID NO: 1451 - DNA, 23 bp, Artificial Sequence
  Description of Artificial Sequence: Synthetic expected off-target sequence
caccccctcccctccgcctcagg

SEQ ID NO: 1452 - DNA, 20 bp, Artificial Sequence
  Description of Artificial Sequence: Synthetic PCR primer
ggggacaggcaggcaaggag

SEQ ID NO: 1453 - DNA, 20 bp, Artificial Sequence
  Description of Artificial Sequence: Synthetic PCR primer
gtgcgtgtccgttcacccct

SEQ ID NO: 1454 - DNA, 23 bp, Artificial Sequence
  Description of Artificial Sequence: Synthetic expected off-target sequence
ctacccctccaccccgcctccgg

SEQ ID NO: 1455 - DNA, 20 bp, Artificial Sequence
  Description of Artificial Sequence: Synthetic PCR primer
aaggggctgctgggtaggac

SEQ ID NO: 1456 - DNA, 20 bp, Artificial Sequence
  Description of Artificial Sequence: Synthetic PCR primer
cgtgattcgagttcctggca

SEQ ID NO: 1457 - DNA, 23 bp, Artificial Sequence
  Description of Artificial Sequence: Synthetic expected off-target sequence
gacccgccccgccccgcctctgg

SEQ ID NO: 1458 - DNA, 20 bp, Artificial Sequence
  Description of Artificial Sequence: Synthetic PCR primer
gaccctcaggaagctgggag

SEQ ID NO: 1459 - DNA, 20 bp, Artificial Sequence
  Description of Artificial Sequence: Synthetic PCR primer
ctgcgagatgccccaaatcg

SEQ ID NO: 1460 - DNA, 23 bp, Artificial Sequence
  Description of Artificial Sequence: Synthetic expected off-target sequence
gatcgactccaccccgcctctgg

SEQ ID NO: 1461 - DNA, 18 bp, Artificial Sequence
  Description of Artificial Sequence: Synthetic PCR primer
ccgcggcgctctgctaga

SEQ ID NO: 1462 - DNA, 20 bp, Artificial Sequence
  Description of Artificial Sequence: Synthetic PCR primer
tgctgggattacaggcgcga

SEQ ID NO: 1463 - DNA, 23 bp, Artificial Sequence
  Description of Artificial Sequence: Synthetic expected off-target sequence
gcccccacccaccccgcctctgg

SEQ ID NO: 1464 - DNA, 20 bp, Artificial Sequence
  Description of Artificial Sequence: Synthetic PCR primer
ccaggtggtgtcagcggagg

SEQ ID NO: 1465 - DNA, 21 bp, Artificial Sequence
  Description of Artificial Sequence: Synthetic PCR primer
tgcctggccctctctgagtct

SEQ ID NO: 1466 - DNA, 23 bp, Artificial Sequence
  Description of Artificial Sequence: Synthetic expected off-target sequence
gccccgctcctccccgcctccgg

SEQ ID NO: 1467 - DNA, 20 bp, Artificial Sequence
  Description of Artificial Sequence: Synthetic PCR primer
cgactccacggcgtctcagg

SEQ ID NO: 1468 - DNA, 20 bp, Artificial Sequence
  Description of Artificial Sequence: Synthetic PCR primer
cagcgcagtccagcccgatg

SEQ ID NO: 1469 - DNA, 23 bp, Artificial Sequence
  Description of Artificial Sequence: Synthetic expected off-target sequence
ggccccctccaccaggcctcagg

SEQ ID NO: 1470 - DNA, 20 bp, Artificial Sequence
  Description of Artificial Sequence: Synthetic PCR primer
cttccctcccccagcaccac

SEQ ID NO: 1471 - DNA, 24 bp, Artificial Sequence
  Description of Artificial Sequence: Synthetic PCR primer
gctacaggttgcacagtgagaggt

SEQ ID NO: 1472 - DNA, 23 bp, Artificial Sequence
  Description of Artificial Sequence: Synthetic expected off-target sequence
ggccccctcctcctcgcctctgg

SEQ ID NO: 1473 - DNA, 20 bp, Artificial Sequence
  Description of Artificial Sequence: Synthetic PCR primer
ccccggggagtctgtcctga

SEQ ID NO: 1474 - DNA, 21 bp, Artificial Sequence
  Description of Artificial Sequence: Synthetic PCR primer
cccagccgttccaggtcttcc

SEQ ID NO: 1475 - DNA, 23 bp, Artificial Sequence
  Description of Artificial Sequence: Synthetic expected off-target sequence
ggcgccctccaccctgcctcggg

SEQ ID NO: 1476 - DNA, 20 bp, Artificial Sequence
  Description of Artificial Sequence: Synthetic PCR primer
gaagcgcgaaaacccggctc

SEQ ID NO: 1477 - DNA, 20 bp, Artificial Sequence
  Description of Artificial Sequence: Synthetic PCR primer
tccagggtccttctcggccc

SEQ ID NO: 1478 - DNA, 23 bp, Artificial Sequence
  Description of Artificial Sequence: Synthetic expected off-target sequence
gtcctccaccaccccgcctctgg

SEQ ID NO: 1479 - DNA, 20 bp, Artificial Sequence
  Description of Artificial Sequence: Synthetic PCR primer
agggtggtcagggaggcctt

SEQ ID NO: 1480 - DNA, 20 bp, Artificial Sequence
  Description of Artificial Sequence: Synthetic PCR primer
catggggctcggacctcgtc

SEQ ID NO: 1481 - DNA, 23 bp, Artificial Sequence
  Description of Artificial Sequence: Synthetic expected off-target sequence
taccccccacaccccgcctctgg

SEQ ID NO: 1482 - DNA, 20 bp, Artificial Sequence
  Description of Artificial Sequence: Synthetic PCR primer
gggaagaggcagggctgtcg

SEQ ID NO: 1483 - DNA, 20 bp, Artificial Sequence
  Description of Artificial Sequence: Synthetic PCR primer
tgccaggaaggaagctggcc

SEQ ID NO: 1484 - DNA, 23 bp, Artificial Sequence
  Description of Artificial Sequence: Synthetic expected off-target sequence
aacccattccaccctgcctcagg

SEQ ID NO: 1485 - DNA, 20 bp, Artificial Sequence
  Description of Artificial Sequence: Synthetic PCR primer
gagtgacgatgagccccggg

SEQ ID NO: 1486 - DNA, 20 bp, Artificial Sequence
  Description of Artificial Sequence: Synthetic PCR primer
cccttagctgcagtcgcccc

SEQ ID NO: 1487 - DNA, 23 bp, Artificial Sequence
  Description of Artificial Sequence: Synthetic expected off-target sequence
acacccccccaccccgcctcagg

SEQ ID NO: 1488 - DNA, 20 bp, Artificial Sequence
  Description of Artificial Sequence: Synthetic PCR primer
cccatgaggggtttgagtgc

SEQ ID NO: 1489 - DNA, 20 bp, Artificial Sequence
  Description of Artificial Sequence: Synthetic PCR primer
tgaagatgggcagtttgggg

SEQ ID NO: 1490 - DNA, 23 bp, Artificial Sequence
  Description of Artificial Sequence: Synthetic expected off-target sequence
agcccccacctccccgcctcggg

SEQ ID NO: 1491 - DNA, 20 bp, Artificial Sequence
  Description of Artificial Sequence: Synthetic PCR primer
cacctggggcatctgggtgg

SEQ ID NO: 1492 - DNA, 20 bp, Artificial Sequence
  Description of Artificial Sequence: Synthetic PCR primer
actggggttggggaggggat

SEQ ID NO: 1493 - DNA, 23 bp, Artificial Sequence
  Description of Artificial Sequence: Synthetic expected off-target sequence
attcccccccaccccgcctcagg

SEQ ID NO: 1494 - DNA, 20 bp, Artificial Sequence
  Description of Artificial Sequence: Synthetic PCR primer
tcatgatccccaaaagggct

SEQ ID NO: 1495 - DNA, 22 bp, Artificial Sequence
  Description of Artificial Sequence: Synthetic PCR primer
ccatttgtgctgatctgtgggt

SEQ ID NO: 1496 - DNA, 23 bp, Artificial Sequence
  Description of Artificial Sequence: Synthetic expected off-target sequence
ccccacccccaccccgcctcagg

SEQ ID NO: 1497 - DNA, 21 bp, Artificial Sequence
  Description of Artificial Sequence: Synthetic PCR primer
tggtgcccagaatagtggcca

SEQ ID NO: 1498 - DNA, 22 bp, Artificial Sequence
  Description of Artificial Sequence: Synthetic PCR primer
aggaaatgtgttgtgccagggc

SEQ ID NO: 1499 - DNA, 23 bp, Artificial Sequence
  Description of Artificial Sequence: Synthetic expected off-target sequence
cccccccaccaccccgccccggg

SEQ ID NO: 1500 - DNA, 20 bp, Artificial Sequence
  Description of Artificial Sequence: Synthetic PCR primer
gcctcagacaaccctgcccc

SEQ ID NO: 1501 - DNA, 27 bp, Artificial Sequence
  Description of Artificial Sequence: Synthetic PCR primer
gccaagtgttactcatcaagaaagtgg

SEQ ID NO: 1502 - DNA, 23 bp, Artificial Sequence
  Description of Artificial Sequence: Synthetic expected off-target sequence
cccccccccccccccgcctcagg

SEQ ID NO: 1503 - DNA, 22 bp, Artificial Sequence
  Description of Artificial Sequence: Synthetic PCR primer
gccgggacaagactgagttggg

SEQ ID NO: 1504 - DNA, 20 bp, Artificial Sequence
  Description of Artificial Sequence: Synthetic PCR primer
tcccgaactcccgcaaaacg

SEQ ID NO: 1505 - DNA, 23 bp, Artificial Sequence
  Description of Artificial Sequence: Synthetic expected off-target sequence
cgccctccccaccccgcctccgg

SEQ ID NO: 1506 - DNA, 20 bp, Artificial Sequence
  Description of Artificial Sequence: Synthetic PCR primer
tgctgcaggtggttccggag

SEQ ID NO: 1507 - DNA, 20 bp, Artificial Sequence
  Description of Artificial Sequence: Synthetic PCR primer
ctggaaccgcatcctccgca

SEQ ID NO: 1508 - DNA, 23 bp, Artificial Sequence
  Description of Artificial Sequence: Synthetic expected off-target sequence
ctccccacccaccccgcctcagg

SEQ ID NO: 1509 - DNA, 21 bp, Artificial Sequence
  Description of Artificial Sequence: Synthetic PCR primer
acactggtccaggtcccgtct

SEQ ID NO: 1510 - DNA, 20 bp, Artificial Sequence
  Description of Artificial Sequence: Synthetic PCR primer
ggctgtgccttccgatggaa

SEQ ID NO: 1511 - DNA, 23 bp, Artificial Sequence
  Description of Artificial Sequence: Synthetic expected off-target sequence
ctctccccccaccccgcctctgg

SEQ ID NO: 1512 - DNA, 20 bp, Artificial Sequence
  Description of Artificial Sequence: Synthetic PCR primer
atcgcgcccaaagcacaggt

SEQ ID NO: 1513 - DNA, 26 bp, Artificial Sequence
  Description of Artificial Sequence: Synthetic PCR primer
aggcttctggaaaagtcctcaatgca

SEQ ID NO: 1514 - DNA, 23 bp, Artificial Sequence
  Description of Artificial Sequence: Synthetic expected off-target sequence
gcctctctgcaccccgcctcagg

SEQ ID NO: 1515 - DNA, 23 bp, Artificial Sequence
  Description of Artificial Sequence: Synthetic expected off-target sequence
gtcactccccaccccgcctctgg

SEQ ID NO: 1516 - DNA, 22 bp, Artificial Sequence
  Description of Artificial Sequence: Synthetic PCR primer
ccctcatggtggtcttacggca

SEQ ID NO: 1517 - DNA, 23 bp, Artificial Sequence
  Description of Artificial Sequence: Synthetic PCR primer
agccacacatctttctggtaggg

SEQ ID NO: 1518 - DNA, 23 bp, Artificial Sequence
  Description of Artificial Sequence: Synthetic expected off-target sequence
tgccccctccccccagcctctgg

SEQ ID NO: 1519 - DNA, 20 bp, Artificial Sequence
  Description of Artificial Sequence: Synthetic PCR primer
tgcgtcgctcatgctgggag

SEQ ID NO: 1520 - DNA, 21 bp, Artificial Sequence
  Description of Artificial Sequence: Synthetic PCR primer
agggtggggtgtactggctca

SEQ ID NO: 1521 - DNA, 23 bp, Artificial Sequence
  Description of Artificial Sequence: Synthetic expected off-target sequence
tgcccctcccaccccgcctctgg

SEQ ID NO: 1522 - DNA, 20 bp, Artificial Sequence
  Description of Artificial Sequence: Synthetic PCR primer
gagctgagacggcaccactg

SEQ ID NO: 1523 - DNA, 20 bp, Artificial Sequence
  Description of Artificial Sequence: Synthetic PCR primer
tggccttgaactcttgggct

SEQ ID NO: 1524 - DNA, 23 bp, Artificial Sequence
  Description of Artificial Sequence: Synthetic expected off-target sequence
ttccccttccacccagcctctgg

SEQ ID NO: 1525 - DNA, 23 bp, Artificial Sequence
  Description of Artificial Sequence: Synthetic expected off-target sequence
ttctccctcctccccgcctcggg

SEQ ID NO: 1526 - DNA, 20 bp, Artificial Sequence
  Description of Artificial Sequence: Synthetic PCR primer
agtgagagtggcacgaacca

SEQ ID NO: 1527 - DNA, 20 bp, Artificial Sequence
  Description of Artificial Sequence: Synthetic PCR primer
cagtaggtggtcccttccgc

SEQ ID NO: 1528 - DNA, 23 bp, Artificial Sequence
  Description of Artificial Sequence: Synthetic expected off-target sequence
accctcgcccaccccgcctcagg

SEQ ID NO: 1529 - DNA, 23 bp, Artificial Sequence
  Description of Artificial Sequence: Synthetic expected off-target sequence
agccaaccccaccccgcctctgg

SEQ ID NO: 1530 - DNA, 20 bp, Artificial Sequence
  Description of Artificial Sequence: Synthetic PCR primer
gggagaaccttgtccagcct

SEQ ID NO: 1531 - DNA, 20 bp, Artificial Sequence
  Description of Artificial Sequence: Synthetic PCR primer
aagccgaaaagctgggcaaa

SEQ ID NO: 1532 - DNA, 23 bp, Artificial Sequence
  Description of Artificial Sequence: Synthetic expected off-target sequence
aggcccccacaccccgcctcagg

SEQ ID NO: 1533 - DNA, 20 bp, Artificial Sequence
  Description of Artificial Sequence: Synthetic PCR primer
cttcccagtgtggcccgtcc

SEQ ID NO: 1534 - DNA, 20 bp, Artificial Sequence
  Description of Artificial Sequence: Synthetic PCR primer
acacagtcagagctccgccg

SEQ ID NO: 1535 - DNA, 23 bp, Artificial Sequence
  Description of Artificial Sequence: Synthetic expected off-target sequence
aggcccccccgccccgcctcagg

SEQ ID NO: 1536 - DNA, 23 bp, Artificial Sequence
  Description of Artificial Sequence: Synthetic expected off-target sequence
atctgccaccaccccgcctccgg

SEQ ID NO: 1537 - DNA, 20 bp, Artificial Sequence
  Description of Artificial Sequence: Synthetic PCR primer
ctgagagggggagggggagg

SEQ ID NO: 1538 - DNA, 21 bp, Artificial Sequence
  Description of Artificial Sequence: Synthetic PCR primer
tcgactggtcttgtcctccca

SEQ ID NO: 1539 - DNA, 23 bp, Artificial Sequence
  Description of Artificial Sequence: Synthetic expected off-target sequence
catcttccccaccccgcctctgg

SEQ ID NO: 1540 - DNA, 20 bp, Artificial Sequence
  Description of Artificial Sequence: Synthetic PCR primer
cagcctgctgcatcggaaaa

SEQ ID NO: 1541 - DNA, 21 bp, Artificial Sequence
  Description of Artificial Sequence: Synthetic PCR primer
tgcagccaagagaaaaagcct

SEQ ID NO: 1542 - DNA, 23 bp, Artificial Sequence
  Description of Artificial Sequence: Synthetic expected off-target sequence
ctttccctccacccagcctctgg

SEQ ID NO: 1543 - DNA, 20 bp, Artificial Sequence
  Description of Artificial Sequence: Synthetic PCR primer
tccctctgacccggaaccca

SEQ ID NO: 1544 - DNA, 21 bp, Artificial Sequence
  Description of Artificial Sequence: Synthetic PCR primer
acccgacttcctccccattgc

SEQ ID NO: 1545 - DNA, 23 bp, Artificial Sequence
  Description of Artificial Sequence: Synthetic expected off-target sequence
gtcgaggtccaccccgcctcagg

SEQ ID NO: 1546 - DNA, 20 bp, Artificial Sequence
  Description of Artificial Sequence: Synthetic PCR primer
tgggggttgcgtgcttgtca

SEQ ID NO: 1547 - DNA, 20 bp, Artificial Sequence
  Description of Artificial Sequence: Synthetic PCR primer
gccaggaggacaccaggacc

SEQ ID NO: 1548 - DNA, 23 bp, Artificial Sequence
  Description of Artificial Sequence: Synthetic expected off-target sequence
gtcgaggtccaccccgcctcagg

SEQ ID NO: 1549 - DNA, 20 bp, Artificial Sequence
  Description of Artificial Sequence: Synthetic PCR primer
atcaggtgccaggaggacac

SEQ ID NO: 1550 - DNA, 20 bp, Artificial Sequence
  Description of Artificial Sequence: Synthetic PCR primer
ggcctgagagtggagagtgg

SEQ ID NO: 1551 - DNA, 23 bp, Artificial Sequence
  Description of Artificial Sequence: Synthetic expected off-target sequence
tcagacctccaccccgcctcagg

SEQ ID NO: 1552 - DNA, 23 bp, Artificial Sequence
  Description of Artificial Sequence: Synthetic expected off-target sequence
tgcaacctcctccccgcctcggg

SEQ ID NO: 1553 - DNA, 24 bp, Artificial Sequence
  Description of Artificial Sequence: Synthetic PCR primer
tgagccacatgaatcaaggcctcc

SEQ ID NO: 1554 - DNA, 26 bp, Artificial Sequence
  Description of Artificial Sequence: Synthetic PCR primer
acctctccaagtctcagtaactctct

SEQ ID NO: 1555 - DNA, 23 bp, Artificial Sequence
  Description of Artificial Sequence: Synthetic expected off-target sequence
accagtctgcaccccgcctctgg

SEQ ID NO: 1556 - DNA, 20 bp, Artificial Sequence
  Description of Artificial Sequence: Synthetic PCR primer
ggtccctctgtgcagtggaa

SEQ ID NO: 1557 - DNA, 20 bp, Artificial Sequence
  Description of Artificial Sequence: Synthetic PCR primer
ctttggtggacctgcacagc

SEQ ID NO: 1558 - DNA, 23 bp, Artificial Sequence
  Description of Artificial Sequence: Synthetic expected off-target sequence
actacccacctccccgcctcagg

SEQ ID NO: 1559 - DNA, 20 bp, Artificial Sequence
  Description of Artificial Sequence: Synthetic PCR primer
gcgaggctgctgacttccct

SEQ ID NO: 1560 - DNA, 23 bp, Artificial Sequence
  Description of Artificial Sequence: Synthetic PCR primer
gctgggactacagacatgtgcca

SEQ ID NO: 1561 - DNA, 23 bp, Artificial Sequence
  Description of Artificial Sequence: Synthetic expected off-target sequence
atttcccccccccccgcctcagg

SEQ ID NO: 1562 - DNA, 20 bp, Artificial Sequence
  Description of Artificial Sequence: Synthetic PCR primer
attgcaggcgtgtccaggca

SEQ ID NO: 1563 - DNA, 23 bp, Artificial Sequence
  Description of Artificial Sequence: Synthetic PCR primer
aaatcctgcatggtgatgggagt

SEQ ID NO: 1564 - DNA, 23 bp, Artificial Sequence
  Description of Artificial Sequence: Synthetic expected off-target sequence
ccaccatcccaccccgcctctgg

SEQ ID NO: 1565 - DNA, 27 bp, Artificial Sequence
  Description of Artificial Sequence: Synthetic PCR primer
tgctctgccatttatgtcctatgaact

SEQ ID NO: 1566 - DNA, 24 bp, Artificial Sequence
  Description of Artificial Sequence: Synthetic PCR primer
acagcctcttctccatgactgagc

SEQ ID NO: 1567 - DNA, 23 bp, Artificial Sequence
  Description of Artificial Sequence: Synthetic expected off-target sequence
cccaagccccaccccgcctcggg

SEQ ID NO: 1568 - DNA, 20 bp, Artificial Sequence
  Description of Artificial Sequence: Synthetic PCR primer
tccgcccaaacaggaggcag

SEQ ID NO: 1569 - DNA, 20 bp, Artificial Sequence
  Description of Artificial Sequence: Synthetic PCR primer
gcggtggggaagccattgag

SEQ ID NO: 1570 - DNA, 23 bp, Artificial Sequence
  Description of Artificial Sequence: Synthetic expected off-target sequence
ccgcgcttccgccccgcctctgg

SEQ ID NO: 1571 - DNA, 20 bp, Artificial Sequence
  Description of Artificial Sequence: Synthetic PCR primer
gggggtctggctcacctgga

SEQ ID NO: 1572 - DNA, 20 bp, Artificial Sequence
  Description of Artificial Sequence: Synthetic PCR primer
cctgtcgggagagtgcctgc

SEQ ID NO: 1573 - DNA, 23 bp, Artificial Sequence
  Description of Artificial Sequence: Synthetic expected off-target sequence
cctgccatgcaccccgcctcagg

SEQ ID NO: 1574 - DNA, 27 bp, Artificial Sequence
  Description of Artificial Sequence: Synthetic PCR primer
tcctggttcatttgctagaactctgga

SEQ ID NO: 1575 - DNA, 21 bp, Artificial Sequence
  Description of Artificial Sequence: Synthetic PCR primer
actccagatgcaaccagggct

SEQ ID NO: 1576 - DNA, 23 bp, Artificial Sequence
  Description of Artificial Sequence: Synthetic expected off-target sequence
ctgcctcctcaccccgcctcagg

SEQ ID NO: 1577 - DNA, 20 bp, Artificial Sequence
  Description of Artificial Sequence: Synthetic PCR primer
cgtgtggtgagcctgagtct

SEQ ID NO: 1578 - DNA, 20 bp, Artificial Sequence
  Description of Artificial Sequence: Synthetic PCR primer
gcttcaccgtagaggctgct

SEQ ID NO: 1579 - DNA, 23 bp, Artificial Sequence
  Description of Artificial Sequence: Synthetic expected off-target sequence
tcttctttccaccccgcctcagg

SEQ ID NO: 1580 - DNA, 25 bp, Artificial Sequence
  Description of Artificial Sequence: Synthetic PCR primer
aggccctgataattcatgctaccaa

SEQ ID NO: 1581 - DNA, 26 bp, Artificial Sequence
  Description of Artificial Sequence: Synthetic PCR primer
tcagtgacaaccttttgtattcggca

SEQ ID NO: 1582 - DNA, 23 bp, Artificial Sequence
  Description of Artificial Sequence: Synthetic expected off-target sequence
ttgaccccccgccccgcctcagg

SEQ ID NO: 1583 - DNA, 23 bp, Artificial Sequence
  Description of Artificial Sequence: Synthetic expected off-target sequence
ggtgagtgagtgtgtgcgtgtgg

SEQ ID NO: 1584 - DNA, 20 bp, Artificial Sequence
  Description of Artificial Sequence: Synthetic PCR primer
tccagatggcacattgtcag

SEQ ID NO: 1585 - DNA, 20 bp, Artificial Sequence
  Description of Artificial Sequence: Synthetic PCR primer
agggagcaggaaagtgaggt

SEQ ID NO: 1586 - DNA, 23 bp, Artificial Sequence
  Description of Artificial Sequence: Synthetic expected off-target sequence
ggtgagtgagtgtgtgtgtgagg

SEQ ID NO: 1587 - DNA, 20 bp, Artificial Sequence
  Description of Artificial Sequence: Synthetic PCR primer
gcaggcaagctgtcaagggt

SEQ ID NO: 1588 - DNA, 20 bp, Artificial Sequence
  Description of Artificial Sequence: Synthetic PCR primer
caccgacacacccactcacc

SEQ ID NO: 1589 - DNA, 23 bp, Artificial Sequence
  Description of Artificial Sequence: Synthetic expected off-target sequence
agtgagtgagtgtgtgtgtgggg

SEQ ID NO: 1590 - DNA, 20 bp, Artificial Sequence
  Description of Artificial Sequence: Synthetic PCR primer
gagggggaagtcaccgacaa

SEQ ID NO: 1591 - DNA, 20 bp, Artificial Sequence
  Description of Artificial Sequence: Synthetic PCR primer
tacccgggccgtctgttaga

SEQ ID NO: 1592 - DNA, 23 bp, Artificial Sequence
  Description of Artificial Sequence: Synthetic expected off-target sequence
agtgtgtgagtgtgtgcgtgtgg

SEQ ID NO: 1593 - DNA, 22 bp, Artificial Sequence
  Description of Artificial Sequence: Synthetic PCR primer
gacaccccacacactctcatgc

SEQ ID NO: 1594 - DNA, 20 bp, Artificial Sequence
  Description of Artificial Sequence: Synthetic PCR primer
tgaatcccttcacccccaag

SEQ ID NO: 1595 - DNA, 23 bp, Artificial Sequence
  Description of Artificial Sequence: Synthetic expected off-target sequence
gctgagtgagtgtatgcgtgtgg

SEQ ID NO: 1596 - DNA, 20 bp, Artificial Sequence
  Description of Artificial Sequence: Synthetic PCR primer
tcctttgaggttcatccccc

SEQ ID NO: 1597 - DNA, 20 bp, Artificial Sequence
  Description of Artificial Sequence: Synthetic PCR primer
ccaatccaggatgattccgc

SEQ ID NO: 1598 - DNA, 23 bp, Artificial Sequence
  Description of Artificial Sequence: Synthetic expected off-target sequence
ggtgagtcagtgtgtgagtgagg

SEQ ID NO: 1599 - DNA, 20 bp, Artificial Sequence
  Description of Artificial Sequence: Synthetic PCR primer
cagggccaggaacacaggaa

SEQ ID NO: 1600 - DNA, 20 bp, Artificial Sequence
  Description of Artificial Sequence: Synthetic PCR primer
gggaggtatgtgcgggagtg

SEQ ID NO: 1601 - DNA, 23 bp, Artificial Sequence
  Description of Artificial Sequence: Synthetic expected off-target sequence
ggtgagtgagagtgtgtgtgtgg

SEQ ID NO: 1602 - DNA, 22 bp, Artificial Sequence
  Description of Artificial Sequence: Synthetic PCR primer
tgcagcctgagtgagcaagtgt

SEQ ID NO: 1603 - DNA, 20 bp, Artificial Sequence
  Description of Artificial Sequence: Synthetic PCR primer
gcccaggtgctaagcccctc

SEQ ID NO: 1604 - DNA, 23 bp, Artificial Sequence
  Description of Artificial Sequence: Synthetic expected off-target sequence
ggtgagtgagtgagtgagtgagg

SEQ ID NO: 1605 - DNA, 20 bp, Artificial Sequence
  Description of Artificial Sequence: Synthetic PCR primer
tacagcctgggtgatggagc

SEQ ID NO: 1606 - DNA, 23 bp, Artificial Sequence
  Description of Artificial Sequence: Synthetic PCR primer
tgtgtcatggactttcccattgt

SEQ ID NO: 1607 - DNA, 23 bp, Artificial Sequence
  Description of Artificial Sequence: Synthetic expected off-target sequence
ggtgagtgagtgagtgagtgagg

SEQ ID NO: 1608 - DNA, 25 bp, Artificial Sequence
  Description of Artificial Sequence: Synthetic PCR primer
ggcaggcattaaactcatcaggtcc

SEQ ID NO: 1609 - DNA, 24 bp, Artificial Sequence
  Description of Artificial Sequence: Synthetic PCR primer
tctcccccaaggtatcagagagct

SEQ ID NO: 1610 - DNA, 23 bp, Artificial Sequence
  Description of Artificial Sequence: Synthetic expected off-target sequence
ggtgagtgagtgcgtgcgggtgg

SEQ ID NO: 1611 - DNA, 20 bp, Artificial Sequence
  Description of Artificial Sequence: Synthetic PCR primer
gggcctccctgctggttctc

SEQ ID NO: 1612 - DNA, 20 bp, Artificial Sequence
  Description of Artificial Sequence: Synthetic PCR primer
gctgccgtccgaacccaaga

SEQ ID NO: 1613 - DNA, 23 bp, Artificial Sequence
  Description of Artificial Sequence: Synthetic expected off-target sequence
ggtgagtgtgtgtgtgagtgtgg

SEQ ID NO: 1614 - DNA, 20 bp, Artificial Sequence
  Description of Artificial Sequence: Synthetic PCR primer
acaaacgcaggtggaccgaa

SEQ ID NO: 1615 - DNA, 21 bp, Artificial Sequence
  Description of Artificial Sequence: Synthetic PCR primer
actccgaaaatgccccgcagt

SEQ ID NO: 1616 - DNA, 23 bp, Artificial Sequence
  Description of Artificial Sequence: Synthetic expected off-target sequence
ggtgagtgtgtgtgtgcatgtgg

SEQ ID NO: 1617 - DNA, 19 bp, Artificial Sequence
  Description of Artificial Sequence: Synthetic PCR primer
aggggaggggacattgcct

SEQ ID NO: 1618 - DNA, 21 bp, Artificial Sequence
  Description of Artificial Sequence: Synthetic PCR primer
ttgagagggttcagtggttgc

SEQ ID NO: 1619 - DNA, 23 bp, Artificial Sequence
  Description of Artificial Sequence: Synthetic expected off-target sequence
ggtgtgtgagtgtgtgtgtgtgg

SEQ ID NO: 1620 - DNA, 20 bp, Artificial Sequence
  Description of Artificial Sequence: Synthetic PCR primer
ctaatgcttacggctgcggg

SEQ ID NO: 1621 - DNA, 20 bp, Artificial Sequence
  Description of Artificial Sequence: Synthetic PCR primer
agccaacggcagatgcaaat

SEQ ID NO: 1622 - DNA, 23 bp, Artificial Sequence
  Description of Artificial Sequence: Synthetic expected off-target sequence
ggtgtgtgtgtgtgtgcgtgcgg

SEQ ID NO: 1623 - DNA, 20 bp, Artificial Sequence
  Description of Artificial Sequence: Synthetic PCR primer
gagcgaagttaacccaccgc

SEQ ID NO: 1624 - DNA, 20 bp, Artificial Sequence
  Description of Artificial Sequence: Synthetic PCR primer
cacacatgcacatgcccctg

SEQ ID NO: 1625 - DNA, 23 bp, Artificial Sequence
  Description of Artificial Sequence: Synthetic expected off-target sequence
ggtgtgtgtgtgtgtgcgtgtgg

SEQ ID NO: 1626 - DNA, 27 bp, Artificial Sequence
  Description of Artificial Sequence: Synthetic PCR primer
gcatgtgtctaactggagacaatagca

SEQ ID NO: 1627 - DNA, 21 bp, Artificial Sequence
  Description of Artificial Sequence: Synthetic PCR primer
tcccccatatcaacacacaca

SEQ ID NO: 1628 - DNA, 23 bp, Artificial Sequence
  Description of Artificial Sequence: Synthetic expected off-target sequence
ggtgtgtgtgtgtgtgcgtgtgg

SEQ ID NO: 1629 - DNA, 20 bp, Artificial Sequence
  Description of Artificial Sequence: Synthetic PCR primer
gcccctcccgccttttgtgt

SEQ ID NO: 1630 - DNA, 24 bp, Artificial Sequence
  Description of Artificial Sequence: Synthetic PCR primer
tgggcaaaggacatgaaacagaca

SEQ ID NO: 1631 - DNA, 23 bp, Artificial Sequence
  Description of Artificial Sequence: Synthetic expected off-target sequence
ggtgtgtgtgtgtgtgcgtgtgg

SEQ ID NO: 1632 - DNA, 23 bp, Artificial Sequence
  Description of Artificial Sequence: Synthetic PCR primer
gcctcagctctgctcttaagccc

SEQ ID NO: 1633 - DNA, 27 bp, Artificial Sequence
  Description of Artificial Sequence: Synthetic PCR primer
acgaacagatcatttttcatggcttcc

SEQ ID NO: 1634 - DNA, 23 bp, Artificial Sequence
  Description of Artificial Sequence: Synthetic expected off-target sequence
gttgagtgaatgtgtgcgtgagg

SEQ ID NO: 1635 - DNA, 20 bp, Artificial Sequence
  Description of Artificial Sequence: Synthetic PCR primer
ctccagagcctggcctacca

SEQ ID NO: 1636 - DNA, 20 bp, Artificial Sequence
  Description of Artificial Sequence: Synthetic PCR primer
ccctctccggaagtgccttg

SEQ ID NO: 1637 - DNA, 23 bp, Artificial Sequence
  Description of Artificial Sequence: Synthetic expected off-target sequence
tgtgggtgagtgtgtgcgtgagg

SEQ ID NO: 1638 - DNA, 23 bp, Artificial Sequence
  Description of Artificial Sequence: Synthetic PCR primer
tctgtcaccacacagttaccacc

SEQ ID NO: 1639 - DNA, 20 bp, Artificial Sequence
  Description of Artificial Sequence: Synthetic PCR primer
gttgcctggggatggggtat

SEQ ID NO: 1640 - DNA, 23 bp, Artificial Sequence
  Description of Artificial Sequence: Synthetic expected off-target sequence
actgtgtgagtgtgtgcgtgagg

SEQ ID NO: 1641 - DNA, 20 bp, Artificial Sequence
  Description of Artificial Sequence: Synthetic PCR primer
ggggaccctcaagaggcact

SEQ ID NO: 1642 - DNA, 20 bp, Artificial Sequence
  Description of Artificial Sequence: Synthetic PCR primer
gggcatcaaaggatggggat

SEQ ID NO: 1643 - DNA, 23 bp, Artificial Sequence
  Description of Artificial Sequence: Synthetic expected off-target sequence
agagagtgagtgtgtgcatgagg

SEQ ID NO: 1644 - DNA, 20 bp, Artificial Sequence
  Description of Artificial Sequence: Synthetic PCR primer
tgtggagggtgggacctggt

SEQ ID NO: 1645 - DNA, 22 bp, Artificial Sequence
  Description of Artificial Sequence: Synthetic PCR primer
acagtgaggtgcggtctttggg

SEQ ID NO: 1646 - DNA, 23 bp, Artificial Sequence
  Description of Artificial Sequence: Synthetic expected off-target sequence
agcgagtgggtgtgtgcgtgggg

SEQ ID NO: 1647 - DNA, 20 bp, Artificial Sequence
  Description of Artificial Sequence: Synthetic PCR primer
cggggtggcagtgacgtcaa

SEQ ID NO: 1648 - DNA, 20 bp, Artificial Sequence
  Description of Artificial Sequence: Synthetic PCR primer
ggtgcagtccaagagccccc

SEQ ID NO: 1649 - DNA, 23 bp, Artificial Sequence
  Description of Artificial Sequence: Synthetic expected off-target sequence
agggagtgactgtgtgcgtgtgg

SEQ ID NO: 1650 - DNA, 20 bp, Artificial Sequence
  Description of Artificial Sequence: Synthetic PCR primer
agctgaggcagagtccccga

SEQ ID NO: 1651 - DNA, 20 bp, Artificial Sequence
  Description of Artificial Sequence: Synthetic PCR primer
gggagacagagcagcgcctc

SEQ ID NO: 1652 - DNA, 23 bp, Artificial Sequence
  Description of Artificial Sequence: Synthetic expected off-target sequence
agtgagtgagtgagtgagtgagg

SEQ ID NO: 1653 - DNA, 20 bp, Artificial Sequence
  Description of Artificial Sequence: Synthetic PCR primer
accaccagaccccacctcca

SEQ ID NO: 1654 - DNA, 22 bp, Artificial Sequence
  Description of Artificial Sequence: Synthetic PCR primer
aggacgacttgtgccccattca

SEQ ID NO: 1655 - DNA, 23 bp, Artificial Sequence
  Description of Artificial Sequence: Synthetic expected off-target sequence
catgagtgagtgtgtgggtgggg

SEQ ID NO: 1656 - DNA, 20 bp, Artificial Sequence
  Description of Artificial Sequence: Synthetic PCR primer
gggtcaggacgcaggtcaga

SEQ ID NO: 1657 - DNA, 20 bp, Artificial Sequence
  Description of Artificial Sequence: Synthetic PCR primer
tccacccacccacccatcct

SEQ ID NO: 1658 - DNA, 23 bp, Artificial Sequence
  Description of Artificial Sequence: Synthetic expected off-target sequence
cgtgagtgtgtgtatgcgtgtgg

SEQ ID NO: 1659 - DNA, 22 bp, Artificial Sequence
  Description of Artificial Sequence: Synthetic PCR primer
acactctgggctaggtgctgga

SEQ ID NO: 1660 - DNA, 21 bp, Artificial Sequence
  Description of Artificial Sequence: Synthetic PCR primer
gccccctcaccacatgatgct

SEQ ID NO: 1661 - DNA, 23 bp, Artificial Sequence
  Description of Artificial Sequence: Synthetic expected off-target sequence
ggactgtgagtgtgtgcgtgagg

SEQ ID NO: 1662 - DNA, 20 bp, Artificial Sequence
  Description of Artificial Sequence: Synthetic PCR primer
ggggccattcctctgctgca

SEQ ID NO: 1663 - DNA, 20 bp, Artificial Sequence
  Description of Artificial Sequence: Synthetic PCR primer
tggggatccttgctcatggc

SEQ ID NO: 1664 - DNA, 23 bp, Artificial Sequence
  Description of Artificial Sequence: Synthetic expected off-target sequence
ggtgtgtgcctgtgtgcgtgtgg

SEQ ID NO: 1665 - DNA, 22 bp, Artificial Sequence
  Description of Artificial Sequence: Synthetic PCR primer
acacactggctcgcattcacca

SEQ ID NO: 1666 - DNA, 20 bp, Artificial Sequence
  Description of Artificial Sequence: Synthetic PCR primer
cctgcacgaggccaggtgtt

SEQ ID NO: 1667 - DNA, 23 bp, Artificial Sequence
  Description of Artificial Sequence: Synthetic expected off-target sequence
gtttcatgagtgtgtgcgtgggg

SEQ ID NO: 1668 - DNA, 23 bp, Artificial Sequence
  Description of Artificial Sequence: Synthetic PCR primer
tgggcacgtagtaaactgcacca

SEQ ID NO: 1669 - DNA, 20 bp, Artificial Sequence
  Description of Artificial Sequence: Synthetic PCR primer
ctcgccgccgtgactgtagg

SEQ ID NO: 1670 - DNA, 23 bp, Artificial Sequence
  Description of Artificial Sequence: Synthetic expected off-target sequence
tgagtgtgagtgtgtgcgtgggg

SEQ ID NO: 1671 - DNA, 20 bp, Artificial Sequence
  Description of Artificial Sequence: Synthetic PCR primer
tcagctggtcctgggcttgg

SEQ ID NO: 1672 - DNA, 22 bp, Artificial Sequence
  Description of Artificial Sequence: Synthetic PCR primer
agagcactgggtagcagtcagt

SEQ ID NO: 1673 - DNA, 23 bp, Artificial Sequence
  Description of Artificial Sequence: Synthetic expected off-target sequence
tgccagtgagtgtgtgcgtgtgg

SEQ ID NO: 1674 - DNA, 20 bp, Artificial Sequence
  Description of Artificial Sequence: Synthetic PCR primer
agacacagccagggcctcag

SEQ ID NO: 1675 - DNA, 20 bp, Artificial Sequence
  Description of Artificial Sequence: Synthetic PCR primer
ggtgggcgtgtgtgtgtacc

SEQ ID NO: 1676 - DNA, 23 bp, Artificial Sequence
  Description of Artificial Sequence: Synthetic expected off-target sequence
tgggtgtgagtgtgtgcgtgtgg

SEQ ID NO: 1677 - DNA, 21 bp, Artificial Sequence
  Description of Artificial Sequence: Synthetic PCR primer
acactctcacacacgcaccaa

SEQ ID NO: 1678 - DNA, 20 bp, Artificial Sequence
  Description of Artificial Sequence: Synthetic PCR primer
gagaagtcagggctggcggg

SEQ ID NO: 1679 - DNA, 23 bp, Artificial Sequence
  Description of Artificial Sequence: Synthetic expected off-target sequence
tgtatgtgagtgtgtgcgtgtgg

SEQ ID NO: 1680 - DNA, 20 bp, Artificial Sequence
  Description of Artificial Sequence: Synthetic PCR primer
actgcctgcatttccccggt

SEQ ID NO: 1681 - DNA, 20 bp, Artificial Sequence
  Description of Artificial Sequence: Synthetic PCR primer
tggtgagggcttcagggagc

SEQ ID NO: 1682 - DNA, 23 bp, Artificial Sequence
  Description of Artificial Sequence: Synthetic expected off-target sequence
tgtgagagagagtgtgcgtgtgg

SEQ ID NO: 1683 - DNA, 20 bp, Artificial Sequence
  Description of Artificial Sequence: Synthetic PCR primer
gccaggttcattgactgccc

SEQ ID NO: 1684 - DNA, 20 bp, Artificial Sequence
  Description of Artificial Sequence: Synthetic PCR primer
tccttctacacatcggcggc

SEQ ID NO: 1685 - DNA, 23 bp, Artificial Sequence
  Description of Artificial Sequence: Synthetic expected off-target sequence
tgtgcctgagtgtgtgcgtgtgg

SEQ ID NO: 1686 - DNA, 20 bp, Artificial Sequence
  Description of Artificial Sequence: Synthetic PCR primer
cgagggagccgagttcgtaa

SEQ ID NO: 1687 - DNA, 20 bp, Artificial Sequence
  Description of Artificial Sequence: Synthetic PCR primer
ctgacctggggctctggtac

SEQ ID NO: 1688 - DNA, 23 bp, Artificial Sequence
  Description of Artificial Sequence: Synthetic expected off-target sequence
tgtgtgtgtgtgtgtgcgtgtgg

SEQ ID NO: 1689 - DNA, 22 bp, Artificial Sequence
  Description of Artificial Sequence: Synthetic PCR primer
tcctcgggaagtcatggcttca

SEQ ID NO: 1690 - DNA, 21 bp, Artificial Sequence
  Description of Artificial Sequence: Synthetic PCR primer
gcactgagcaaccaggagcac

SEQ ID NO: 1691 - DNA, 23 bp, Artificial Sequence
  Description of Artificial Sequence: Synthetic expected off-target sequence
agcgtgtgagtgtatgcgtgggg

SEQ ID NO: 1692 - DNA, 23 bp, Artificial Sequence
  Description of Artificial Sequence: Synthetic expected off-target sequence
attgagtgtgtgagtgcgtgggg

SEQ ID NO: 1693 - DNA, 20 bp, Artificial Sequence
  Description of Artificial Sequence: Synthetic PCR primer
taaaccgttgcccccgcctc

SEQ ID NO: 1694 - DNA, 20 bp, Artificial Sequence
  Description of Artificial Sequence: Synthetic PCR primer
gctcccctgccaggtgaacc

SEQ ID NO: 1695 - DNA, 23 bp, Artificial Sequence
  Description of Artificial Sequence: Synthetic expected off-target sequence
catgtgtgggtgtgtgcgtgtgg

SEQ ID NO: 1696 - DNA, 20 bp, Artificial Sequence
  Description of Artificial Sequence: Synthetic PCR primer
cctgctgagactccaggtcc

SEQ ID NO: 1697 - DNA, 20 bp, Artificial Sequence
  Description of Artificial Sequence: Synthetic PCR primer
ctgcggagtggctggctata

SEQ ID NO: 1698 - DNA, 23 bp, Artificial Sequence
  Description of Artificial Sequence: Synthetic expected off-target sequence
cccgagtgtgtgtgtgcgtgtgg

SEQ ID NO: 1699 - DNA, 20 bp, Artificial Sequence
  Description of Artificial Sequence: Synthetic PCR primer
ctcggggactgacaagccgg

SEQ ID NO: 1700 - DNA, 20 bp, Artificial Sequence
  Description of Artificial Sequence: Synthetic PCR primer
ggagcagctcttccagggcc

SEQ ID NO: 1701 - DNA, 23 bp, Artificial Sequence
  Description of Artificial Sequence: Synthetic expected off-target sequence
ctggagtgagtgtgtgtgtgtgg

SEQ ID NO: 1702 - DNA, 20 bp, Artificial Sequence
  Description of Artificial Sequence: Synthetic PCR primer
ccccgaccaaagcaggagca

SEQ ID NO: 1703 - DNA, 20 bp, Artificial Sequence
  Description of Artificial Sequence: Synthetic PCR primer
ctggcagcctctggatgggg

SEQ ID NO: 1704 - DNA, 23 bp, Artificial Sequence
  Description of Artificial Sequence: Synthetic expected off-target sequence
gtttcatgagtgtgtgcgtgggg

SEQ ID NO: 1705 - DNA, 23 bp, Artificial Sequence
  Description of Artificial Sequence: Synthetic expected off-target sequence
tatgtgtgcgtgtgtgcgtgtgg

SEQ ID NO: 1706 - DNA, 20 bp, Artificial Sequence
  Description of Artificial Sequence: Synthetic PCR primer
atttcagagccccggggaaa

SEQ ID NO: 1707 - DNA, 20 bp, Artificial Sequence
  Description of Artificial Sequence: Synthetic PCR primer
aggccgcggtgttatggtta

SEQ ID NO: 1708 - DNA, 23 bp, Artificial Sequence
  Description of Artificial Sequence: Synthetic expected off-target sequence
tatgtgtgtgtgtgtgcgtgggg

SEQ ID NO: 1709 - DNA, 24 bp, Artificial Sequence
  Description of Artificial Sequence: Synthetic PCR primer
gccagtggcttagtgtctttgtgt

SEQ ID NO: 1710 - DNA, 25 bp, Artificial Sequence
  Description of Artificial Sequence: Synthetic PCR primer
tgacatattttcctgggccatgggt

SEQ ID NO: 1711 - DNA, 23 bp, Artificial Sequence
  Description of Artificial Sequence: Synthetic expected off-target sequence
tctgtgtgtgtgtgtgcgtgggg

SEQ ID NO: 1712 - DNA, 22 bp, Artificial Sequence
  Description of Artificial Sequence: Synthetic PCR primer
tgccagaagaacatgggccaga

SEQ ID NO: 1713 - DNA, 27 bp, Artificial Sequence
  Description of Artificial Sequence: Synthetic PCR primer
ccatgctgacatcatatactgggaagc

SEQ ID NO: 1714 - DNA, 23 bp, Artificial Sequence
  Description of Artificial Sequence: Synthetic expected off-target sequence
tctgtgtgtgtgtgtgcgtgtgg

SEQ ID NO: 1715 - DNA, 20 bp, Artificial Sequence
  Description of Artificial Sequence: Synthetic PCR primer
gcgtgtctctgtgtgcgtgc

SEQ ID NO: 1716 - DNA, 20 bp, Artificial Sequence
  Description of Artificial Sequence: Synthetic PCR primer
ccaggctgggcacacaggtt

SEQ ID NO: 1717 - DNA, 23 bp, Artificial Sequence
  Description of Artificial Sequence: Synthetic expected off-target sequence
tgagcgtgagtgtgagcgtgtgg

SEQ ID NO: 1718 - DNA, 23 bp, Artificial Sequence
  Description of Artificial Sequence: Synthetic expected off-target sequence
tgtctttgagtgtgtgcgtgtgg

SEQ ID NO: 1719 - DNA, 25 bp, Artificial Sequence
  Description of Artificial Sequence: Synthetic PCR primer
tgcccagtccaatatttcagcagct

SEQ ID NO: 1720 - DNA, 26 bp, Artificial Sequence
  Description of Artificial Sequence: Synthetic PCR primer
aggatgagttcatgtcctttgtgggg

SEQ ID NO: 1721 - DNA, 23 bp, Artificial Sequence
  Description of Artificial Sequence: Synthetic expected off-target sequence
tttgtgtgtgtgtgtgcgtgtgg

SEQ ID NO: 1722 - DNA, 27 bp, Artificial Sequence
  Description of Artificial Sequence: Synthetic PCR primer
gggtgaaaatttggtactgttagctgt

SEQ ID NO: 1723 - DNA, 27 bp, Artificial Sequence
  Description of Artificial Sequence: Synthetic PCR primer
aatgactcattccctgggtatctccca

SEQ ID NO: 1724 - DNA, 23 bp, Artificial Sequence
  Description of Artificial Sequence: Synthetic expected off-target sequence
aaggcgtgtgtgtgtgcgtgtgg

SEQ ID NO: 1725 - DNA, 21 bp, Artificial Sequence
  Description of Artificial Sequence: Synthetic PCR primer
tgccccatcaatcacctcggc

SEQ ID NO: 1726 - DNA, 20 bp, Artificial Sequence
  Description of Artificial Sequence: Synthetic PCR primer
caaggtcggcagggcagtga

SEQ ID NO: 1727 - DNA, 23 bp, Artificial Sequence
  Description of Artificial Sequence: Synthetic expected off-target sequence
aattcgtgtgtgtgtgcgtgggg

SEQ ID NO: 1728 - DNA, 20 bp, Artificial Sequence
  Description of Artificial Sequence: Synthetic PCR primer
gcctcctctgccgctggtaa

SEQ ID NO: 1729 - DNA, 24 bp, Artificial Sequence
  Description of Artificial Sequence: Synthetic PCR primer
tgagagttcctgttgctccacact

SEQ ID NO: 1730 - DNA, 23 bp, Artificial Sequence
  Description of Artificial Sequence: Synthetic expected off-target sequence
atggtgtgtgtgtgtgcgtgtgg

SEQ ID NO: 1731 - DNA, 23 bp, Artificial Sequence
  Description of Artificial Sequence: Synthetic expected off-target sequence
cacgtgtgtgtgtgtgcgtgtgg

SEQ ID NO: 1732 - DNA, 20 bp, Artificial Sequence
  Description of Artificial Sequence: Synthetic PCR primer
gccaccaaaatagccagcgt

SEQ ID NO: 1733 - DNA, 20 bp, Artificial Sequence
  Description of Artificial Sequence: Synthetic PCR primer
acatgcatctgtgtgtgcgt

SEQ ID NO: 1734 - DNA, 23 bp, Artificial Sequence
  Description of Artificial Sequence: Synthetic expected off-target sequence
gaaatttgagtgtgtgcgtgtgg

SEQ ID NO: 1735 - DNA, 27 bp, Artificial Sequence
  Description of Artificial Sequence: Synthetic PCR primer
acagactgacccttgaaaaataccagt

SEQ ID NO: 1736 - DNA, 27 bp, Artificial Sequence
  Description of Artificial Sequence: Synthetic PCR primer
tgtatctttcttgccaatggttttccc

SEQ ID NO: 1737 - DNA, 23 bp, Artificial Sequence
  Description of Artificial Sequence: Synthetic expected off-target sequence
taagtgtgtgtgtgtgcgtgtgg

SEQ ID NO: 1738 - DNA, 25 bp, Artificial Sequence
  Description of Artificial Sequence: Synthetic PCR primer
agccaaatttctcaacagcagcact

SEQ ID NO: 1739 - DNA, 23 bp, Artificial Sequence
  Description of Artificial Sequence: Synthetic PCR primer
tcctggagagcaggcatttttgt

SEQ ID NO: 1740 - DNA, 23 bp, Artificial Sequence
  Description of Artificial Sequence: Synthetic expected off-target sequence
tatatgtgtgtgtgtgcgtgggg

SEQ ID NO: 1741 - DNA, 20 bp, Artificial Sequence
  Description of Artificial Sequence: Synthetic PCR primer
acctccttgtgctgcctggc

SEQ ID NO: 1742 - DNA, 20 bp, Artificial Sequence
  Description of Artificial Sequence: Synthetic PCR primer
ggcgggaaggtaaccctggg

SEQ ID NO: 1743 - DNA, 23 bp, Artificial Sequence
  Description of Artificial Sequence: Synthetic expected off-target sequence
tatctgtgtgtgtgtgcgtgtgg

SEQ ID NO: 1744 - DNA, 27 bp, Artificial Sequence
  Description of Artificial Sequence: Synthetic PCR primer
cacaaagctctacctttccagtagtgt

SEQ ID NO: 1745 - DNA, 23 bp, Artificial Sequence
  Description of Artificial Sequence: Synthetic PCR primer
tgatccgatggttgttcacagct

SEQ ID NO: 1746 - DNA, 23 bp, Artificial Sequence
  Description of Artificial Sequence: Synthetic expected off-target sequence
tttatgtgtgtgtgtgcgtgtgg

SEQ ID NO: 1747 - DNA, 21 bp, Artificial Sequence
  Description of Artificial Sequence: Synthetic PCR primer
tgtggggattacctgcctggc

SEQ ID NO: 1748 - DNA, 22 bp, Artificial Sequence
  Description of Artificial Sequence: Synthetic PCR primer
acgcacaaaaatgcccttgtca

SEQ ID NO: 1749 - DNA, 23 bp, Artificial Sequence
  Description of Artificial Sequence: Synthetic expected off-target sequence
tttttgtgtgtgtgtgcgtgggg

SEQ ID NO: 1750 - DNA, 22 bp, Artificial Sequence
  Description of Artificial Sequence: Synthetic PCR primer
tgaggcagaccagtcatccagc

SEQ ID NO: 1751 - DNA, 20 bp, Artificial Sequence
  Description of Artificial Sequence: Synthetic PCR primer
gcccgagcacagtgtagggc

SEQ ID NO: 1752 - DNA, 23 bp, Artificial Sequence
  Description of Artificial Sequence: Synthetic expected off-target sequence
aaaaattgtgtgtgtgcgtgggg

SEQ ID NO: 1753 - DNA, 20 bp, Artificial Sequence
  Description of Artificial Sequence: Synthetic PCR primer
attagctgggcgtggcggag

SEQ ID NO: 1754 - DNA, 23 bp, Artificial Sequence
  Description of Artificial Sequence: Synthetic PCR primer
actgcatctcatctcaggcagct

SEQ ID NO: 1755 - DNA, 23 bp, Artificial Sequence
  Description of Artificial Sequence: Synthetic expected off-target sequence
acaatgtgtgtgtgtgcgtgtgg

SEQ ID NO: 1756 - DNA, 24 bp, Artificial Sequence
  Description of Artificial Sequence: Synthetic PCR primer
tgaagcagaaggagtggagaagga

SEQ ID NO: 1757 - DNA, 27 bp, Artificial Sequence
  Description of Artificial Sequence: Synthetic PCR primer
tcagcttcacatctgtttcagttcagt

SEQ ID NO: 1758 - DNA, 23 bp, Artificial Sequence
  Description of Artificial Sequence: Synthetic expected off-target sequence
atgtggtgtgtgtgtgcgtgtgg

SEQ ID NO: 1759 - DNA, 20 bp, Artificial Sequence
  Description of Artificial Sequence: Synthetic PCR primer
tggtggagtgtgtgtgtggt

SEQ ID NO: 1760 - DNA, 21 bp, Artificial Sequence
  Description of Artificial Sequence: Synthetic PCR primer
agagcagaaagagagtgccca

SEQ ID NO: 1761 - DNA, 23 bp, Artificial Sequence
  Description of Artificial Sequence: Synthetic expected off-target sequence
caaaattgtgtgtgtgcgtgtgg

SEQ ID NO: 1762 - DNA, 21 bp, Artificial Sequence
  Description of Artificial Sequence: Synthetic PCR primer
gcccctgtacgtcctgacagc

SEQ ID NO: 1763 - DNA, 23 bp, Artificial Sequence
  Description of Artificial Sequence: Synthetic PCR primer
tgcacaagccacttagcctctct

SEQ ID NO: 1764 - DNA, 23 bp, Artificial Sequence
  Description of Artificial Sequence: Synthetic expected off-target sequence
ccctggtgtgtgtgtgcgtgtgg

SEQ ID NO: 1765 - DNA, 20 bp, Artificial Sequence
  Description of Artificial Sequence: Synthetic PCR primer
agcgcaggtaaacaggccca

SEQ ID NO: 1766 - DNA, 21 bp, Artificial Sequence
  Description of Artificial Sequence: Synthetic PCR primer
tctctcgccccgtttccttgt

SEQ ID NO: 1767 - DNA, 23 bp, Artificial Sequence
  Description of Artificial Sequence: Synthetic expected off-target sequence
tccgcttgtgtgtgtgcgtgggg

SEQ ID NO: 1768 - DNA, 20 bp, Artificial Sequence
  Description of Artificial Sequence: Synthetic PCR primer
atgggtgccaggtaccacgc

SEQ ID NO: 1769 - DNA, 20 bp, Artificial Sequence
  Description of Artificial Sequence: Synthetic PCR primer
acagcaggaaggagccgcag

SEQ ID NO: 1770 - DNA, 23 bp, Artificial Sequence
  Description of Artificial Sequence: Synthetic expected off-target sequence
tcctcgtgtgtgtgtgcgtgtgg

SEQ ID NO: 1771 - DNA, 20 bp, Artificial Sequence
  Description of Artificial Sequence: Synthetic PCR primer
cgggcgggtggacagatgag

SEQ ID NO: 1772 - DNA, 20 bp, Artificial Sequence
  Description of Artificial Sequence: Synthetic PCR primer
aggaggtctcgagccagggg

SEQ ID NO: 1773 - DNA, 23 bp, Artificial Sequence
  Description of Artificial Sequence: Synthetic expected off-target sequence
ttaaggtgggtgtgtgcgtgggg

SEQ ID NO: 1774 - DNA, 26 bp, Artificial Sequence
  Description of Artificial Sequence: Synthetic PCR primer
tcaacctagtgaacacagaccactga

SEQ ID NO: 1775 - DNA, 27 bp, Artificial Sequence
  Description of Artificial Sequence: Synthetic PCR primer
gtctatatacagcccacaacctcatgt

SEQ ID NO: 1776 - DNA, 23 bp, Artificial Sequence
  Description of Artificial Sequence: Synthetic expected off-target sequence
ttatattgtgtgtgtgcgtgggg

SEQ ID NO: 1777 - DNA, 20 bp, Artificial Sequence
  Description of Artificial Sequence: Synthetic PCR primer
gccagggccagtggattgct

SEQ ID NO: 1778 - DNA, 26 bp, Artificial Sequence
  Description of Artificial Sequence: Synthetic PCR primer
tgtcatttcttagtatgtcagccgga

SEQ ID NO: 1779 - DNA, 23 bp, Artificial Sequence
  Description of Artificial Sequence: Synthetic expected off-target sequence
ttgaggagagtgtgtgcgtgagg

SEQ ID NO: 1780 - DNA, 20 bp, Artificial Sequence
  Description of Artificial Sequence: Synthetic PCR primer
gagccccaccggttcagtcc

SEQ ID NO: 1781 - DNA, 20 bp, Artificial Sequence
  Description of Artificial Sequence: Synthetic PCR primer
gccagagctacccactcgcc

SEQ ID NO: 1782-1784 - skipped (3 entries)

SEQ ID NO: 1785 - DNA, 23 bp, Artificial Sequence
  Description of Artificial Sequence: Synthetic expected off-target sequence
gagtccgagcagaagaagaaggg

SEQ ID NO: 1786 - DNA, 20 bp, Artificial Sequence
  Description of Artificial Sequence: Synthetic PCR primer
ggagcagctggtcagagggg

SEQ ID NO: 1787 - DNA, 20 bp, Artificial Sequence
  Description of Artificial Sequence: Synthetic PCR primer
gggaagggggacactgggga

SEQ ID NO: 1788 - DNA, 23 bp, Artificial Sequence
  Description of Artificial Sequence: Synthetic expected off-target sequence
gagttagagcagaagaagaaagg

SEQ ID NO: 1789 - DNA, 25 bp, Artificial Sequence
  Description of Artificial Sequence: Synthetic PCR primer
tctctccttcaactcatgaccagct

SEQ ID NO: 1790 - DNA, 27 bp, Artificial Sequence
  Description of Artificial Sequence: Synthetic PCR primer
atctgcacatgtatgtacaggagtcat

SEQ ID NO: 1791 - DNA, 23 bp, Artificial Sequence
  Description of Artificial Sequence: Synthetic expected off-target sequence
aagtcagaggagaagaagaaggg

SEQ ID NO: 1792 - DNA, 23 bp, Artificial Sequence
  Description of Artificial Sequence: Synthetic PCR primer
tggggaatctccaaagaaccccc

SEQ ID NO: 1793 - DNA, 24 bp, Artificial Sequence
  Description of Artificial Sequence: Synthetic PCR primer
agggtgtactgtgggaactttgca

SEQ ID NO: 1794 - DNA, 23 bp, Artificial Sequence
  Description of Artificial Sequence: Synthetic expected off-target sequence
aagtccgaggagaggaagaaagg

SEQ ID NO: 1795 - DNA, 20 bp, Artificial Sequence
  Description of Artificial Sequence: Synthetic PCR primer
gatggccccactgagcacgt

SEQ ID NO: 1796 - DNA, 26 bp, Artificial Sequence
  Description of Artificial Sequence: Synthetic PCR primer
acttcgtagagccttaaacatgtggc

SEQ ID NO: 1797 - DNA, 23 bp, Artificial Sequence
  Description of Artificial Sequence: Synthetic expected off-target sequence
aagtctgagcacaagaagaatgg

SEQ ID NO: 1798 - DNA, 27 bp, Artificial Sequence
  Description of Artificial Sequence: Synthetic PCR primer
aggattaatgtttaaagtcactggtgg

SEQ ID NO: 1799 - DNA, 23 bp, Artificial Sequence
  Description of Artificial Sequence: Synthetic PCR primer
tcaaacaaggtgcagatacagca

SEQ ID NO: 1800 - DNA, 23 bp, Artificial Sequence
  Description of Artificial Sequence: Synthetic expected off-target sequence
acgtctgagcagaagaagaatgg

SEQ ID NO: 1801 - DNA, 24 bp, Artificial Sequence
  Description of Artificial Sequence: Synthetic PCR primer
tccaagccactggtttctcagtca

SEQ ID NO: 1802 - DNA, 26 bp, Artificial Sequence
  Description of Artificial Sequence: Synthetic PCR primer
tgctctgtggatcatattttggggga

SEQ ID NO: 1803 - DNA, 23 bp, Artificial Sequence
  Description of Artificial Sequence: Synthetic expected off-target sequence
gactcctagcaaaagaagaatgg

SEQ ID NO: 1804 - DNA, 22 bp, Artificial Sequence
  Description of Artificial Sequence: Synthetic PCR primer
actttcagagcttggggcaggt

SEQ ID NO: 1805 - DNA, 21 bp, Artificial Sequence
  Description of Artificial Sequence: Synthetic PCR primer
cccacgctgaagtgcaatggc

SEQ ID NO: 1806 - DNA, 23 bp, Artificial Sequence
  Description of Artificial Sequence: Synthetic expected off-target sequence
gagactgagaagaagaagaaagg

SEQ ID NO: 1807 - DNA, 20 bp, Artificial Sequence
  Description of Artificial Sequence: Synthetic PCR primer
caaagcatgcctttcagccg

SEQ ID NO: 1808 - DNA, 20 bp, Artificial Sequence
  Description of Artificial Sequence: Synthetic PCR primer
ggctcttcgatttggcacct

SEQ ID NO: 1809 - DNA, 23 bp, Artificial Sequence
  Description of Artificial Sequence: Synthetic expected off-target sequence
gagccggagcagaagaaggaggg

SEQ ID NO: 1810 - DNA, 23 bp, Artificial Sequence
  Description of Artificial Sequence: Synthetic expected off-target sequence
gagcctgagcagaaggagaaggg

SEQ ID NO: 1811 - DNA, 20 bp, Artificial Sequence
  Description of Artificial Sequence: Synthetic PCR primer
ggactccctgcagctccagc

SEQ ID NO: 1812 - DNA, 20 bp, Artificial Sequence
  Description of Artificial Sequence: Synthetic PCR primer
aggaacacaggccaggctgg

SEQ ID NO: 1813 - DNA, 23 bp, Artificial Sequence
  Description of Artificial Sequence: Synthetic expected off-target sequence
gaggccgagcagaagaaagacgg

SEQ ID NO: 1814 - DNA, 20 bp, Artificial Sequence
  Description of Artificial Sequence: Synthetic PCR primer
ccctttaggcaccttcccca

SEQ ID NO: 1815 - DNA, 20 bp, Artificial Sequence
  Description of Artificial Sequence: Synthetic PCR primer
ccgaccttcatccctcctgg

SEQ ID NO: 1816 - DNA, 23 bp, Artificial Sequence
  Description of Artificial Sequence: Synthetic expected off-target sequence
gagtaagagaagaagaagaaggg

SEQ ID NO: 1817 - DNA, 24 bp, Artificial Sequence
  Description of Artificial Sequence: Synthetic PCR primer
tgattctgccttagagtcccaggt

SEQ ID NO: 1818 - DNA, 21 bp, Artificial Sequence
  Description of Artificial Sequence: Synthetic PCR primer
tgggctctgtgtccctaccca

SEQ ID NO: 1819 - DNA, 23 bp, Artificial Sequence
  Description of Artificial Sequence: Synthetic expected off-target sequence
gagtaggaggagaagaagaaagg

SEQ ID NO: 1820 - DNA, 23 bp, Artificial Sequence
  Description of Artificial Sequence: Synthetic expected off-target sequence
gagtccgggaaggagaagaaagg

SEQ ID NO: 1821 - DNA, 20 bp, Artificial Sequence
  Description of Artificial Sequence: Synthetic PCR primer
aggcaggagagcaagcaggt

SEQ ID NO: 1822 - DNA, 23 bp, Artificial Sequence
  Description of Artificial Sequence: Synthetic PCR primer
accctgactactgactgaccgct

SEQ ID NO: 1823 - DNA, 23 bp, Artificial Sequence
  Description of Artificial Sequence: Synthetic expected off-target sequence
gattcctaccagaagaagaatgg

SEQ ID NO: 1824 - DNA, 20 bp, Artificial Sequence
  Description of Artificial Sequence: Synthetic PCR primer
ctccccattgcgacccgagg

SEQ ID NO: 1825 - DNA, 23 bp, Artificial Sequence
  Description of Artificial Sequence: Synthetic PCR primer
agaggcattgacttggagcacct

SEQ ID NO: 1826 - DNA, 23 bp, Artificial Sequence
  Description of Artificial Sequence: Synthetic expected off-target sequence
gcgacagagcagaagaagaaggg

SEQ ID NO: 1827 - DNA, 20 bp, Artificial Sequence
  Description of Artificial Sequence: Synthetic PCR primer
ctggagcccagcaggaaggc

SEQ ID NO: 1828 - DNA, 20 bp, Artificial Sequence
  Description of Artificial Sequence: Synthetic PCR primer
cctcagggagggggcctgat

SEQ ID NO: 1829 - DNA, 23 bp, Artificial Sequence
  Description of Artificial Sequence: Synthetic expected off-target sequence
aaatccaaccagaagaagaaagg

SEQ ID NO: 1830 - DNA, 20 bp, Artificial Sequence
  Description of Artificial Sequence: Synthetic PCR primer
actgtgggcgttgtccccac

SEQ ID NO: 1831 - DNA, 22 bp, Artificial Sequence
  Description of Artificial Sequence: Synthetic PCR primer
aggtcggtgcagggtttaagga

SEQ ID NO: 1832 - DNA, 23 bp, Artificial Sequence
  Description of Artificial Sequence: Synthetic expected off-target sequence
aagtctgaggacaagaagaatgg

SEQ ID NO: 1833 - DNA, 22 bp, Artificial Sequence
  Description of Artificial Sequence: Synthetic PCR primer
ggcgctccctttttccctttgt

SEQ ID NO: 1834 - DNA, 21 bp, Artificial Sequence
  Description of Artificial Sequence: Synthetic PCR primer
cgtcacccatcgtctcgtgga

SEQ ID NO: 1835 - DNA, 23 bp, Artificial Sequence
  Description of Artificial Sequence: Synthetic expected off-target sequence
aagttggagcaggagaagaaggg

SEQ ID NO: 1836 - DNA, 21 bp, Artificial Sequence
  Description of Artificial Sequence: Synthetic PCR primer
tgccatctatagcagccccct

SEQ ID NO: 1837 - DNA, 27 bp, Artificial Sequence
  Description of Artificial Sequence: Synthetic PCR primer
gcatcttgctaaccgtacttcttctga

SEQ ID NO: 1838 - DNA, 23 bp, Artificial Sequence
  Description of Artificial Sequence: Synthetic expected off-target sequence
aatacagagcagaagaagaatgg

SEQ ID NO: 1839 - DNA, 24 bp, Artificial Sequence
  Description of Artificial Sequence: Synthetic PCR primer
gtggagacgctaaacctgtgaggt

SEQ ID NO: 1840 - DNA, 22 bp, Artificial Sequence
  Description of Artificial Sequence: Synthetic PCR primer
gctcctggcctcttcctacagc

SEQ ID NO: 1841 - DNA, 23 bp, Artificial Sequence
  Description of Artificial Sequence: Synthetic expected off-target sequence
aggtactagcagaagaagaaagg

SEQ ID NO: 1842 - DNA, 24 bp, Artificial Sequence
  Description of Artificial Sequence: Synthetic PCR primer
ccgaacttctgctgagcttgatgc

SEQ ID NO: 1843 - DNA, 23 bp, Artificial Sequence
  Description of Artificial Sequence: Synthetic PCR primer
ccaagtcaatgggcaacaaggga

SEQ ID NO: 1844 - DNA, 23 bp, Artificial Sequence
  Description of Artificial Sequence: Synthetic expected off-target sequence
aggtgctagcagaagaagaaggg

SEQ ID NO: 1845 - DNA, 23 bp, Artificial Sequence
  Description of Artificial Sequence: Synthetic expected off-target sequence
aggtgggagcagaagaagaaggg

SEQ ID NO: 1846 - DNA, 20 bp, Artificial Sequence
  Description of Artificial Sequence: Synthetic PCR primer
tgcccccaagacctttctcc

SEQ ID NO: 1847 - DNA, 20 bp, Artificial Sequence
  Description of Artificial Sequence: Synthetic PCR primer
atggcaggcagaggaggaag

SEQ ID NO: 1848 - DNA, 23 bp, Artificial Sequence
  Description of Artificial Sequence: Synthetic expected off-target sequence
caaacggagcagaagaagaaagg

SEQ ID NO: 1849 - DNA, 20 bp, Artificial Sequence
  Description of Artificial Sequence: Synthetic PCR primer
gggtggggccattgtgggtt

SEQ ID NO: 1850 - DNA, 20 bp, Artificial Sequence
  Description of Artificial Sequence: Synthetic PCR primer
ctggggccagggtttctgcc

SEQ ID NO: 1851 - DNA, 23 bp, Artificial Sequence
  Description of Artificial Sequence: Synthetic expected off-target sequence
cactctgaggagaagaagaaagg

SEQ ID NO: 1852 - DNA, 23 bp, Artificial Sequence
  Description of Artificial Sequence: Synthetic PCR primer
tggagaacatgagaggcttgcaa

SEQ ID NO: 1853 - DNA, 24 bp, Artificial Sequence
  Description of Artificial Sequence: Synthetic PCR primer
tccttctgtaggcaatgggaacaa

SEQ ID NO: 1854 - DNA, 23 bp, Artificial Sequence
  Description of Artificial Sequence: Synthetic expected off-target sequence
cagtcatggcagaagaagaaagg

SEQ ID NO: 1855 - DNA, 20 bp, Artificial Sequence
  Description of Artificial Sequence: Synthetic PCR primer
gccacatggtagaagtcggc

SEQ ID NO: 1856 - DNA, 20 bp, Artificial Sequence
  Description of Artificial Sequence: Synthetic PCR primer
ggcagatttcccccatgctg

SEQ ID NO: 1857 - DNA, 23 bp, Artificial Sequence
  Description of Artificial Sequence: Synthetic expected off-target sequence
ccgtcccagcagtagaagaatgg

SEQ ID NO: 1858 - DNA, 20 bp, Artificial Sequence
  Description of Artificial Sequence: Synthetic PCR primer
tgtacaccccaagtcctccc

SEQ ID NO: 1859 - DNA, 20 bp, Artificial Sequence
  Description of Artificial Sequence: Synthetic PCR primer
aaggggagtgtgcaagcctc

SEQ ID NO: 1860 - DNA, 23 bp, Artificial Sequence
  Description of Artificial Sequence: Synthetic expected off-target sequence
gtctgcgatcagaagaagaaagg

SEQ ID NO: 1861 - DNA, 22 bp, Artificial Sequence
  Description of Artificial Sequence: Synthetic PCR primer
aggtctggctagagatgcagca

SEQ ID NO: 1862 - DNA, 24 bp, Artificial Sequence
  Description of Artificial Sequence: Synthetic PCR primer
agtccaacactcaggtgagaccct

SEQ ID NO: 1863 - DNA, 23 bp, Artificial Sequence
  Description of Artificial Sequence: Synthetic expected off-target sequence
taatccaatcagaagaagaaggg

SEQ ID NO: 1864 - DNA, 22 bp, Artificial Sequence
  Description of Artificial Sequence: Synthetic PCR primer
ccaagaggacccagctgttgga

SEQ ID NO: 1865 - DNA, 27 bp, Artificial Sequence
  Description of Artificial Sequence: Synthetic PCR primer
gggtatggaattctggattagcagagc

SEQ ID NO: 1866 - DNA, 23 bp, Artificial Sequence
  Description of Artificial Sequence: Synthetic expected off-target sequence
tatacggagcagaagaagaatgg

SEQ ID NO: 1867 - DNA, 26 bp, Artificial Sequence
  Description of Artificial Sequence: Synthetic PCR primer
accatctcttcattgatgagtcccaa

SEQ ID NO: 1868 - DNA, 22 bp, Artificial Sequence
  Description of Artificial Sequence: Synthetic PCR primer
acactgtgagtatgcttggcgt

SEQ ID NO: 1869 - DNA, 23 bp, Artificial Sequence
  Description of Artificial Sequence: Synthetic expected off-target sequence
acttccctgcagaagaagaaagg

SEQ ID NO: 1870 - DNA, 20 bp, Artificial Sequence
  Description of Artificial Sequence: Synthetic PCR primer
ggctgcggggagatgagctc

SEQ ID NO: 1871 - DNA, 22 bp, Artificial Sequence
  Description of Artificial Sequence: Synthetic PCR primer
tcggatgcttttccacagggct

SEQ ID NO: 1872 - DNA, 23 bp, Artificial Sequence
  Description of Artificial Sequence: Synthetic expected off-target sequence
aggactgggcagaagaagaaggg

SEQ ID NO: 1873 - DNA, 20 bp, Artificial Sequence
  Description of Artificial Sequence: Synthetic PCR primer
tcttccaggagggcagctcc

SEQ ID NO: 1874 - DNA, 24 bp, Artificial Sequence
  Description of Artificial Sequence: Synthetic PCR primer
ccaatcctgagctcctacaaggct

SEQ ID NO: 1875 - DNA, 23 bp, Artificial Sequence
  Description of Artificial Sequence: Synthetic expected off-target sequence
aggttggagaagaagaagaaggg

SEQ ID NO: 1876 - DNA, 20 bp, Artificial Sequence
  Description of Artificial Sequence: Synthetic PCR primer
gagctgcactggatggcact

SEQ ID NO: 1877 - DNA, 23 bp, Artificial Sequence
  Description of Artificial Sequence: Synthetic PCR primer
tgctggttaaggggtgttttgga

SEQ ID NO: 1878 - DNA, 23 bp, Artificial Sequence
  Description of Artificial Sequence: Synthetic expected off-target sequence
agttcagagcaggagaagaatgg

SEQ ID NO: 1879 - DNA, 21 bp, Artificial Sequence
  Description of Artificial Sequence: Synthetic PCR primer
tctgggaaggtgaggaggcca

SEQ ID NO: 1880 - DNA, 24 bp, Artificial Sequence
  Description of Artificial Sequence: Synthetic PCR primer
tgggggacaatggaaaagcaatga

SEQ ID NO: 1881 - DNA, 23 bp, Artificial Sequence
  Description of Artificial Sequence: Synthetic expected off-target sequence
atgacacagcagaagaagaaggg

SEQ ID NO: 1882 - DNA, 20 bp, Artificial Sequence
  Description of Artificial Sequence: Synthetic PCR primer
cttgctcccagcctgacccc

SEQ ID NO: 1883 - DNA, 20 bp, Artificial Sequence
  Description of Artificial Sequence: Synthetic PCR primer
agcccttgccatgcaggacc

SEQ ID NO: 1884 - DNA, 23 bp, Artificial Sequence
  Description of Artificial Sequence: Synthetic expected off-target sequence
atgacagagaagaagaagaaagg

SEQ ID NO: 1885 - DNA, 25 bp, Artificial Sequence
  Description of Artificial Sequence: Synthetic PCR primer
gggatttttatctgttgggtgcgaa

SEQ ID NO: 1886 - DNA, 24 bp, Artificial Sequence
  Description of Artificial Sequence: Synthetic PCR primer
aaccacagatgtaccctcaaagct

SEQ ID NO: 1887 - DNA, 23 bp, Artificial Sequence
  Description of Artificial Sequence: Synthetic expected off-target sequence
ccgcccctgcagaagaagaacgg

SEQ ID NO: 1888 - DNA, 20 bp, Artificial Sequence
  Description of Artificial Sequence: Synthetic PCR primer
acccatcaggaccgcagcac

SEQ ID NO: 1889 - DNA, 20 bp, Artificial Sequence
  Description of Artificial Sequence: Synthetic PCR primer
tctggaacctgggaggcgga

SEQ ID NO: 1890 - DNA, 23 bp, Artificial Sequence
  Description of Artificial Sequence: Synthetic expected off-target sequence
gcaggagagcagaagaagaaagg

SEQ ID NO: 1891 - DNA, 20 bp, Artificial Sequence
  Description of Artificial Sequence: Synthetic PCR primer
cgtccctcacagccagcctc

SEQ ID NO: 1892 - DNA, 20 bp, Artificial Sequence
  Description of Artificial Sequence: Synthetic PCR primer
cctccttgggcctggggttc

SEQ ID NO: 1893 - DNA, 23 bp, Artificial Sequence
  Description of Artificial Sequence: Synthetic expected off-target sequence
gttcaagagcagaagaagaatgg

SEQ ID NO: 1894 - DNA, 22 bp, Artificial Sequence
  Description of Artificial Sequence: Synthetic PCR primer
ccctctgcaaggtggagtctcc

SEQ ID NO: 1895 - DNA, 21 bp, Artificial Sequence
  Description of Artificial Sequence: Synthetic PCR primer
agatgttctgtccccaggcct

SEQ ID NO: 1896 - DNA, 23 bp, Artificial Sequence
  Description of Artificial Sequence: Synthetic expected off-target sequence
gttttgaagcagaagaagaaagg

SEQ ID NO: 1897 - DNA, 21 bp, Artificial Sequence
  Description of Artificial Sequence: Synthetic PCR primer
ggcttccactgctgaaggcct

SEQ ID NO: 1898 - DNA, 20 bp, Artificial Sequence
  Description of Artificial Sequence: Synthetic PCR primer
tgccgctccacataccctcc

SEQ ID NO: 1899 - DNA, 23 bp, Artificial Sequence
  Description of Artificial Sequence: Synthetic expected off-target sequence
tatggcaagcagaagaagaaagg

SEQ ID NO: 1900 - DNA, 22 bp, Artificial Sequence
  Description of Artificial Sequence: Synthetic PCR primer
agcattgcctgtcgggtgatgt

SEQ ID NO: 1901 - DNA, 25 bp, Artificial Sequence
  Description of Artificial Sequence: Synthetic PCR primer
agcacctattggacactggttctct

SEQ ID NO: 1902 - DNA, 23 bp, Artificial Sequence
  Description of Artificial Sequence: Synthetic expected off-target sequence
tggtgggatcagaagaagaaagg

SEQ ID NO: 1903 - DNA, 21 bp, Artificial Sequence
  Description of Artificial Sequence: Synthetic PCR primer
tctagagcaggggcacaatgc

SEQ ID NO: 1904 - DNA, 21 bp, Artificial Sequence
  Description of Artificial Sequence: Synthetic PCR primer
tggagatggagcctggtggga

SEQ ID NO: 1905 - DNA, 23 bp, Artificial Sequence
  Description of Artificial Sequence: Synthetic expected off-target sequence
acccacgggcagaagaagaaggg

SEQ ID NO: 1906 - DNA, 27 bp, Artificial Sequence
  Description of Artificial Sequence: Synthetic PCR primer
ggtctcagaaaatggagagaaagcacg

SEQ ID NO: 1907 - DNA, 20 bp, Artificial Sequence
  Description of Artificial Sequence: Synthetic PCR primer
cccacagaaacctgggccct

SEQ ID NO: 1908 - DNA, 23 bp, Artificial Sequence
  Description of Artificial Sequence: Synthetic expected off-target sequence
actcctgatcagaagaagaaggg

SEQ ID NO: 1909 - DNA, 26 bp, Artificial Sequence
  Description of Artificial Sequence: Synthetic PCR primer
ggttgctgataccaaaacgtttgcct

SEQ ID NO: 1910 - DNA, 21 bp, Artificial Sequence
  Description of Artificial Sequence: Synthetic PCR primer
tgggtcctctccacctctgca

SEQ ID NO: 1911 - DNA, 23 bp, Artificial Sequence
  Description of Artificial Sequence: Synthetic expected off-target sequence
actgatgagcagaagaagaaagg

SEQ ID NO: 1912 - DNA, 27 bp, Artificial Sequence
  Description of Artificial Sequence: Synthetic PCR primer
actctccttaagtactgatatggctgt

SEQ ID NO: 1913 - DNA, 22 bp, Artificial Sequence
  Description of Artificial Sequence: Synthetic PCR primer
cagaatcttgctctgttgccca

SEQ ID NO: 1914 - DNA, 23 bp, Artificial Sequence
  Description of Artificial Sequence: Synthetic expected off-target sequence
attttagtgcagaagaagaaagg

SEQ ID NO: 1915 - DNA, 23 bp, Artificial Sequence
  Description of Artificial Sequence: Synthetic expected off-target sequence
attttagtgcagaagaagaaagg

SEQ ID NO: 1916 - DNA, 23 bp, Artificial Sequence
  Description of Artificial Sequence: Synthetic expected off-target sequence
ccatggcagcagaagaagaaggg

SEQ ID NO: 1917 - DNA, 21 bp, Artificial Sequence
  Description of Artificial Sequence: Synthetic PCR primer
caatgcctgcagtcctcagga

SEQ ID NO: 1918 - DNA, 26 bp, Artificial Sequence
  Description of Artificial Sequence: Synthetic PCR primer
tcccaagagaaaactctgtcctgaca

SEQ ID NO: 1919 - DNA, 23 bp, Artificial Sequence
  Description of Artificial Sequence: Synthetic expected off-target sequence
ccattacagcagaagaagaaggg

SEQ ID NO: 1920 - DNA, 20 bp, Artificial Sequence
  Description of Artificial Sequence: Synthetic PCR primer
gcattggctgcccagggaaa

SEQ ID NO: 1921 - DNA, 20 bp, Artificial Sequence
  Description of Artificial Sequence: Synthetic PCR primer
tggctgtgctgggctgtgtt

SEQ ID NO: 1922 - DNA, 23 bp, Artificial Sequence
  Description of Artificial Sequence: Synthetic expected off-target sequence
cgaggcgggcagaagaagaaagg

SEQ ID NO: 1923 - DNA, 21 bp, Artificial Sequence
  Description of Artificial Sequence: Synthetic PCR primer
ccacaagcctcagcctacccg

SEQ ID NO: 1924 - DNA, 21 bp, Artificial Sequence
  Description of Artificial Sequence: Synthetic PCR primer
acaggtgccaaaacactgcct

SEQ ID NO: 1925 - DNA, 23 bp, Artificial Sequence
  Description of Artificial Sequence: Synthetic expected off-target sequence
tcattgcagcagaagaagaaagg

SEQ ID NO: 1926 - DNA, 25 bp, Artificial Sequence
  Description of Artificial Sequence: Synthetic PCR primer
gcctcttgcaaatgagactcctttt

SEQ ID NO: 1927 - DNA, 20 bp, Artificial Sequence
  Description of Artificial Sequence: Synthetic PCR primer
cgatcagtcccctggcgtcc

SEQ ID NO: 1928 - DNA, 23 bp, Artificial Sequence
  Description of Artificial Sequence: Synthetic expected off-target sequence
tctccagggcagaagaagaaagg

SEQ ID NO: 1929 - DNA, 20 bp, Artificial Sequence
  Description of Artificial Sequence: Synthetic PCR primer
tcccagaatctgcctccgca

SEQ ID NO: 1930 - DNA, 21 bp, Artificial Sequence
  Description of Artificial Sequence: Synthetic PCR primer
aggggtttccaggcacatggg

SEQ ID NO: 1931-1933 - skipped (3 entries)

SEQ ID NO: 1934 - DNA, 23 bp, Artificial Sequence
  Description of Artificial Sequence: Synthetic expected off-target sequence
gtcatcttagtcattacctgagg

SEQ ID NO: 1935 - DNA, 30 bp, Artificial Sequence; identical to SEQ ID NO: 652
  Description of Artificial Sequence: Synthetic PCR primer

SEQ ID NO: 1936 - DNA, 30 bp, Artificial Sequence; identical to SEQ ID NO: 963
  Description of Artificial Sequence: Synthetic PCR primer

SEQ ID NO: 1937 - DNA, 23 bp, Artificial Sequence
  Description of Artificial Sequence: Synthetic expected off-target sequence
ggtatctaagtcattacctgtgg

SEQ ID NO: 1938 - DNA, 26 bp, Artificial Sequence
  Description of Artificial Sequence: Synthetic PCR primer
acatctggggaaagcaaaagtcaaca

SEQ ID NO: 1939 - DNA, 27 bp, Artificial Sequence
  Description of Artificial Sequence: Synthetic PCR primer
tgtctgagtatctaggctaaaagtggt

SEQ ID NO: 1940 - DNA, 23 bp, Artificial Sequence
  Description of Artificial Sequence: Synthetic expected off-target sequence
gtaatattagtcattaccggtgg

SEQ ID NO: 1941 - DNA, 26 bp, Artificial Sequence
  Description of Artificial Sequence: Synthetic PCR primer
acgatcttgcttcatttccctgtaca

SEQ ID NO: 1942 - DNA, 27 bp, Artificial Sequence
  Description of Artificial Sequence: Synthetic PCR primer
agtgctttgtgaactgaaaagcaaaca

SEQ ID NO: 1943 - DNA, 23 bp, Artificial Sequence
  Description of Artificial Sequence: Synthetic expected off-target sequence
gtaatctgagtcatttcctgggg

SEQ ID NO: 1944 - DNA, 23 bp, Artificial Sequence
  Description of Artificial Sequence: Synthetic PCR primer
gcaccttggtgctgctaaatgcc

SEQ ID NO: 1945 - DNA, 24 bp, Artificial Sequence
  Description of Artificial Sequence: Synthetic PCR primer
gggcaactgaacaggcatgaatgg

SEQ ID NO: 1946 - DNA, 23 bp, Artificial Sequence
  Description of Artificial Sequence: Synthetic expected off-target sequence
gtcatcctagtcatttactgggg

SEQ ID NO: 1947 - DNA, 20 bp, Artificial Sequence
  Description of Artificial Sequence: Synthetic PCR primer
aactgtcctgcatccccgcc

SEQ ID NO: 1948 - DNA, 20 bp, Artificial Sequence
  Description of Artificial Sequence: Synthetic PCR primer
ggtgcacctggatccaccca

SEQ ID NO: 1949 - DNA, 23 bp, Artificial Sequence
  Description of Artificial Sequence: Synthetic expected off-target sequence
gtcatcctagtgcttacctgagg

SEQ ID NO: 1950-1951 - skipped (2 entries)

SEQ ID NO: 1952 - DNA, 23 bp, Artificial Sequence
  Description of Artificial Sequence: Synthetic expected off-target sequence
gtcatctgaggcattaactgggg

SEQ ID NO: 1953 - DNA, 20 bp, Artificial Sequence
  Description of Artificial Sequence: Synthetic PCR primer
catcaccctccaccaggccc

SEQ ID NO: 1954 - DNA, 20 bp, Artificial Sequence
  Description of Artificial Sequence: Synthetic PCR primer
accactgctgcaggctccag

SEQ ID NO: 1955 - DNA, 23 bp, Artificial Sequence
  Description of Artificial Sequence: Synthetic expected off-target sequence
aatatgttagtcattacctgagg

SEQ ID NO: 1956 - DNA, 23 bp, Artificial Sequence
  Description of Artificial Sequence: Synthetic expected off-target sequence
ataaacgtagtcattacctgggg

SEQ ID NO: 1957 - DNA, 20 bp, Artificial Sequence
  Description of Artificial Sequence: Synthetic PCR primer
cctgacccgtggttcccgac

SEQ ID NO: 1958 - DNA, 20 bp, Artificial Sequence
  Description of Artificial Sequence: Synthetic PCR primer
tggtgcgtggtgtgtgtggt

SEQ ID NO: 1959 - DNA, 23 bp, Artificial Sequence
  Description of Artificial Sequence: Synthetic expected off-target sequence
atcatcatcgtcattatctgggg

SEQ ID NO: 1960 - DNA, 25 bp, Artificial Sequence
  Description of Artificial Sequence: Synthetic PCR primer
tgggaacattggagaagtttcctga

SEQ ID NO: 1961 - DNA, 22 bp, Artificial Sequence
  Description of Artificial Sequence: Synthetic PCR primer
ccatgtgactactgggctgccc

SEQ ID NO: 1962 - DNA, 23 bp, Artificial Sequence
  Description of Artificial Sequence: Synthetic expected off-target sequence
atcattttactcattacttgtgg

SEQ ID NO: 1963 - DNA, 21 bp, Artificial Sequence
  Description of Artificial Sequence: Synthetic PCR primer
agccttggcaagcaactccct

SEQ ID NO: 1964 - DNA, 27 bp, Artificial Sequence
  Description of Artificial Sequence: Synthetic PCR primer
ggttctctctctcagaaaagaaagagg

SEQ ID NO: 1965 - DNA, 23 bp, Artificial Sequence
  Description of Artificial Sequence: Synthetic expected off-target sequence
atcattttagtcatctcctgtgg

SEQ ID NO: 1966 - DNA, 20 bp, Artificial Sequence
  Description of Artificial Sequence: Synthetic PCR primer
ggcagcggacttcagagcca

SEQ ID NO: 1967 - DNA, 21 bp, Artificial Sequence
  Description of Artificial Sequence: Synthetic PCR primer
gccagaggctctcagcagtgc

SEQ ID NO: 1968 - DNA, 23 bp, Artificial Sequence
  Description of Artificial Sequence: Synthetic expected off-target sequence
cacagcttagtcatcacctgggg

SEQ ID NO: 1969 - DNA, 20 bp, Artificial Sequence
  Description of Artificial Sequence: Synthetic PCR primer
ccagcctggtcaatatggca

SEQ ID NO: 1970 - DNA, 20 bp, Artificial Sequence
  Description of Artificial Sequence: Synthetic PCR primer
actgtgcccagccccatatt

SEQ ID NO: 1971 - DNA, 23 bp, Artificial Sequence
  Description of Artificial Sequence: Synthetic expected off-target sequence
cccagcttagtcattagctgtgg

SEQ ID NO: 1972 - DNA, 20 bp, Artificial Sequence
  Description of Artificial Sequence: Synthetic PCR primer
atgccaacactcgaggggcc

SEQ ID NO: 1973 - DNA, 20 bp, Artificial Sequence
  Description of Artificial Sequence: Synthetic PCR primer
cgggttgtggcaccgggtta

SEQ ID NO: 1974 - DNA, 23 bp, Artificial Sequence
  Description of Artificial Sequence: Synthetic expected off-target sequence
ctcacctttgtcatttcctgagg

SEQ ID NO: 1975 - DNA, 20 bp, Artificial Sequence
  Description of Artificial Sequence: Synthetic PCR primer
ttgctctagtggggaggggg

SEQ ID NO: 1976 - DNA, 27 bp, Artificial Sequence
  Description of Artificial Sequence: Synthetic PCR primer
agagttcaggcatgaaaagaagcaaca

SEQ ID NO: 1977 - DNA, 23 bp, Artificial Sequence
  Description of Artificial Sequence: Synthetic expected off-target sequence
ctcattttattcattgcctgggg

SEQ ID NO: 1978 - DNA, 26 bp, Artificial Sequence
  Description of Artificial Sequence: Synthetic PCR primer
agctgaagatagcagtgtttaagcct

SEQ ID NO: 1979 - DNA, 23 bp, Artificial Sequence
  Description of Artificial Sequence: Synthetic PCR primer
tgcaatttgaggggctctcttca

SEQ ID NO: 1980 - DNA, 23 bp, Artificial Sequence
  Description of Artificial Sequence: Synthetic expected off-target sequence
ctctccttagtcactacctgagg

SEQ ID NO: 1981 - DNA, 22 bp, Artificial Sequence
  Description of Artificial Sequence: Synthetic PCR primer
agtcactggagtaagcctgcct

SEQ ID NO: 1982 - DNA, 25 bp, Artificial Sequence
  Description of Artificial Sequence: Synthetic PCR primer
tgccagccaaaagttgttagtgtgt

SEQ ID NO: 1983 - DNA, 23 bp, Artificial Sequence
  Description of Artificial Sequence: Synthetic expected off-target sequence
cttatctctgtcattacctgggg

SEQ ID NO: 1984 - DNA, 20 bp, Artificial Sequence
  Description of Artificial Sequence: Synthetic PCR primer
gggtctccctcagtgccctg

SEQ ID NO: 1985 - DNA, 24 bp, Artificial Sequence
  Description of Artificial Sequence: Synthetic PCR primer
tgtgtggtagggagcaaaacgaca

SEQ ID NO: 1986 - DNA, 23 bp, Artificial Sequence
  Description of Artificial Sequence: Synthetic expected off-target sequence
gacagctccgtcattacctgggg

SEQ ID NO: 1987 - DNA, 21 bp, Artificial Sequence
  Description of Artificial Sequence: Synthetic PCR primer
tgggggctgttaagaggcaca

SEQ ID NO: 1988 - DNA, 20 bp, Artificial Sequence
  Description of Artificial Sequence: Synthetic PCR primer
tgaccacacacacccccacg

SEQ ID NO: 1989 - DNA, 23 bp, Artificial Sequence
  Description of Artificial Sequence: Synthetic expected off-target sequence
gccacctcagtcattagctgggg

SEQ ID NO: 1990 - DNA, 26 bp, Artificial Sequence
  Description of Artificial Sequence: Synthetic PCR primer
tcaaaacagattgaccaaggccaaat

SEQ ID NO: 1991 - DNA, 24 bp, Artificial Sequence
  Description of Artificial Sequence: Synthetic PCR primer
tgtgtttttaagctgcaccccagg

SEQ ID NO: 1992 - DNA, 23 bp, Artificial Sequence
  Description of Artificial Sequence: Synthetic expected off-target sequence
ggaatcttactcattacttgggg

SEQ ID NO: 1993 - DNA, 24 bp, Artificial Sequence
  Description of Artificial Sequence: Synthetic PCR primer
tctggcaccaggactgattgtaca

SEQ ID NO: 1994 - DNA, 20 bp, Artificial Sequence
  Description of Artificial Sequence: Synthetic PCR primer
gcacgcagctgactcccaga

SEQ ID NO: 1995 - DNA, 23 bp, Artificial Sequence
  Description of Artificial Sequence: Synthetic expected off-target sequence
gtggcctcagtcattacctgcgg

SEQ ID NO: 1996 - DNA, 23 bp, Artificial Sequence
  Description of Artificial Sequence: Synthetic expected off-target sequence
gttgttttagtgattacctgagg

SEQ ID NO: 1997 - DNA, 25 bp, Artificial Sequence
  Description of Artificial Sequence: Synthetic PCR primer
agcatctgtgataccctacctgtct

SEQ ID NO: 1998 - DNA, 20 bp, Artificial Sequence
  Description of Artificial Sequence: Synthetic PCR primer
accagggctgccacagagtc

SEQ ID NO: 1999 - DNA, 23 bp, Artificial Sequence
  Description of Artificial Sequence: Synthetic expected off-target sequence
tacatcttagtcctcacctgtgg

SEQ ID NO: 2000 - DNA, 20 bp, Artificial Sequence
  Description of Artificial Sequence: Synthetic PCR primer
tagtcttgttgcccaggctg

SEQ ID NO: 2001 - DNA, 20 bp, Artificial Sequence
  Description of Artificial Sequence: Synthetic PCR primer
ctcggcccctgagagttcat

SEQ ID NO: 2002 - DNA, 23 bp, Artificial Sequence
  Description of Artificial Sequence: Synthetic expected off-target sequence
tccatctcactcattacctgagg

SEQ ID NO: 2003 - DNA, 20 bp, Artificial Sequence
  Description of Artificial Sequence: Synthetic PCR primer
ctgcaaccagggcccttacc

SEQ ID NO: 2004 - DNA, 20 bp, Artificial Sequence
  Description of Artificial Sequence: Synthetic PCR primer
gagcagcagcaaagccaccg

SEQ ID NO: 2005 - DNA, 23 bp, Artificial Sequence
  Description of Artificial Sequence: Synthetic expected off-target sequence
ttcatcctagtcaacacctgggg

SEQ ID NO: 2006 - DNA, 20 bp, Artificial Sequence
  Description of Artificial Sequence: Synthetic PCR primer
gcctggagagcaagcctggg

SEQ ID NO: 2007 - DNA, 20 bp, Artificial Sequence
  Description of Artificial Sequence: Synthetic PCR primer
agccgagacaatctgccccg

SEQ ID NO: 2008 - DNA, 23 bp, Artificial Sequence
  Description of Artificial Sequence: Synthetic expected off-target sequence
tttatattagtgattacctgtgg

SEQ ID NO: 2009 - DNA, 26 bp, Artificial Sequence
  Description of Artificial Sequence: Synthetic PCR primer
agtgaaacaaacaagcagcagtctga

SEQ ID NO: 2010 - DNA, 20 bp, Artificial Sequence
  Description of Artificial Sequence: Synthetic PCR primer
ggcaggtctgaccagtgggg

SEQ ID NO: 2011 - DNA, 23 bp, Artificial Sequence
  Description of Artificial Sequence: Synthetic expected off-target sequence
aacgtgtaagtcattacctgagg

SEQ ID NO: 2012 - DNA, 24 bp, Artificial Sequence
  Description of Artificial Sequence: Synthetic PCR primer
aggctcagagaggtaagcaatgga

SEQ ID NO: 2013 - DNA, 27 bp, Artificial Sequence
  Description of Artificial Sequence: Synthetic PCR primer
tgagtagacagaaatgttaccggtgtt

SEQ ID NO: 2014 - DNA, 23 bp, Artificial Sequence
  Description of Artificial Sequence: Synthetic expected off-target sequence
aagatcacagtcattacctgggg

SEQ ID NO: 2015 - DNA, 25 bp, Artificial Sequence
  Description of Artificial Sequence: Synthetic PCR primer
tcagagatgttaaagccttggtggg

SEQ ID NO: 2016 - DNA, 22 bp, Artificial Sequence
  Description of Artificial Sequence: Synthetic PCR primer
agtgaaccaagggaatggggga

SEQ ID NO: 2017 - DNA, 23 bp, Artificial Sequence
  Description of Artificial Sequence: Synthetic expected off-target sequence
agaatattagtccttacctgggg

SEQ ID NO: 2018 - DNA, 22 bp, Artificial Sequence
  Description of Artificial Sequence: Synthetic PCR primer
tgtgctttctggggtagtggca

SEQ ID NO: 2019 - DNA, 22 bp, Artificial Sequence
  Description of Artificial Sequence: Synthetic PCR primer
cacctcagccctgtagtcctgg

SEQ ID NO: 2020 - DNA, 23 bp, Artificial Sequence
  Description of Artificial Sequence: Synthetic expected off-target sequence
agcagattagtgattacctgggg

SEQ ID NO: 2021 - DNA, 22 bp, Artificial Sequence
  Description of Artificial Sequence: Synthetic PCR primer
ccattgggtgactgaatgcaca

SEQ ID NO: 2022 - DNA, 20 bp, Artificial Sequence
  Description of Artificial Sequence: Synthetic PCR primer
gccactgtccccagcctatt

SEQ ID NO: 2023 - DNA, 23 bp, Artificial Sequence
  Description of Artificial Sequence: Synthetic expected off-target sequence
agtagcttagtgattacctgggg

SEQ ID NO: 2024 - DNA, 24 bp, Artificial Sequence
  Description of Artificial Sequence: Synthetic PCR primer
accaagaaagtgaaaaggaaaccc

SEQ ID NO: 2025 - DNA, 23 bp, Artificial Sequence
  Description of Artificial Sequence: Synthetic PCR primer
tgagatggcatacgatttaccca

SEQ ID NO: 2026 - DNA, 23 bp, Artificial Sequence
  Description of Artificial Sequence: Synthetic expected off-target sequence
cacggcttactcattacctgggg

SEQ ID NO: 2027 - DNA, 22 bp, Artificial Sequence
  Description of Artificial Sequence: Synthetic PCR primer
agggtggggactgaaaggagct

SEQ ID NO: 2028 - DNA, 26 bp, Artificial Sequence
  Description of Artificial Sequence: Synthetic PCR primer
tggcatcactcagagattggaacaca

SEQ ID NO: 2029 - DNA, 23 bp, Artificial Sequence
  Description of Artificial Sequence: Synthetic expected off-target sequence
catatgttaggcattacctgggg

SEQ ID NO: 2030 - DNA, 22 bp, Artificial Sequence
  Description of Artificial Sequence: Synthetic PCR primer
accagtgctgtgtgaccttgga

SEQ ID NO: 2031 - DNA, 22 bp, Artificial Sequence
  Description of Artificial Sequence: Synthetic PCR primer
tcctatgggaggggaggcttct

SEQ ID NO: 2032 - DNA, 23 bp, Artificial Sequence
  Description of Artificial Sequence: Synthetic expected off-target sequence
catttcttagtcatttcctgagg

SEQ ID NO: 2033 - DNA, 21 bp, Artificial Sequence
  Description of Artificial Sequence: Synthetic PCR primer
ccaggtgtggtggttcatgac

SEQ ID NO: 2034 - DNA, 22 bp, Artificial Sequence
  Description of Artificial Sequence: Synthetic PCR primer
gcatacggcagtagaatgagcc

SEQ ID NO: 2035 - DNA, 23 bp, Artificial Sequence
  Description of Artificial Sequence: Synthetic expected off-target sequence
tgcagctaactcattacctgcgg

SEQ ID NO: 2036 - DNA, 21 bp, Artificial Sequence
  Description of Artificial Sequence: Synthetic PCR primer
caggcgctgggttcttagcct

SEQ ID NO: 2037 - DNA, 20 bp, Artificial Sequence
  Description of Artificial Sequence: Synthetic PCR primer
ccttcctgggccccatggtg

SEQ ID NO: 2038 - DNA, 23 bp, Artificial Sequence
  Description of Artificial Sequence: Synthetic expected off-target sequence
ttgcttttagttattacctgggg

SEQ ID NO: 2039 - DNA, 20 bp, Artificial Sequence
  Description of Artificial Sequence: Synthetic PCR primer
tggggtccaagatgtcccct

SEQ ID NO: 2040 - DNA, 24 bp, Artificial Sequence
  Description of Artificial Sequence: Synthetic PCR primer
tgaaactgcttgatgaggtgtgga

SEQ ID NO: 2041 - DNA, 23 bp, Artificial Sequence
  Description of Artificial Sequence: Synthetic expected off-target sequence
aacttgaaagtcattacctgtgg

SEQ ID NO: 2042 - DNA, 21 bp, Artificial Sequence
  Description of Artificial Sequence: Synthetic PCR primer
gctgggcttggtggtatatgc

SEQ ID NO: 2043 - DNA, 25 bp, Artificial Sequence
  Description of Artificial Sequence: Synthetic PCR primer
acttgcaaagctgataactgactga

SEQ ID NO: 2044 - DNA, 23 bp, Artificial Sequence
  Description of Artificial Sequence: Synthetic expected off-target sequence
aaggtcacagtcattacctgggg

SEQ ID NO: 2045 - DNA, 23 bp, Artificial Sequence
  Description of Artificial Sequence: Synthetic PCR primer
agttggtgtcactgacaatggga

SEQ ID NO: 2046 - DNA, 20 bp, Artificial Sequence
  Description of Artificial Sequence: Synthetic PCR primer
cgcagcgcacgagttcatca

SEQ ID NO: 2047 - DNA, 23 bp, Artificial Sequence
  Description of Artificial Sequence: Synthetic expected off-target sequence
aatgtcttcatcattacctgagg

SEQ ID NO: 2048 - DNA, 23 bp, Artificial Sequence
  Description of Artificial Sequence: Synthetic PCR primer
agaggaggcacaattcaacccct

SEQ ID NO: 2049 - DNA, 20 bp, Artificial Sequence
  Description of Artificial Sequence: Synthetic PCR primer
ggctggggaggcctcacaat

SEQ ID NO: 2050 - DNA, 23 bp, Artificial Sequence
  Description of Artificial Sequence: Synthetic expected off-target sequence
agatgcttggtcattacctgtgg

SEQ ID NO: 2051 - DNA, 23 bp, Artificial Sequence
  Description of Artificial Sequence: Synthetic PCR primer
gggaaagtttgggaaagtcagca

SEQ ID NO: 2052 - DNA, 20 bp, Artificial Sequence
  Description of Artificial Sequence: Synthetic PCR primer
aggacaagctaccccacacc

SEQ ID NO: 2053 - DNA, 23 bp, Artificial Sequence
  Description of Artificial Sequence: Synthetic expected off-target sequence
agtagattagttattacctgggg

SEQ ID NO: 2054 - DNA, 23 bp, Artificial Sequence
  Description of Artificial Sequence: Synthetic PCR primer
tggtgcatcaaagggttgcttct

SEQ ID NO: 2055 - DNA, 20 bp, Artificial Sequence
  Description of Artificial Sequence: Synthetic PCR primer
tcattccagcacgccgggag

SEQ ID NO: 2056 - DNA, 23 bp, Artificial Sequence
  Description of Artificial Sequence: Synthetic expected off-target sequence
agtaggttagtaattacctgggg

SEQ ID NO: 2057 - DNA, 20 bp, Artificial Sequence
  Description of Artificial Sequence: Synthetic PCR primer
cccaggctgcccatcacact

SEQ ID NO: 2058 - DNA, 25 bp, Artificial Sequence
  Description of Artificial Sequence: Synthetic PCR primer
tggagtaagtataccttggggacct

SEQ ID NO: 2059 - DNA, 23 bp, Artificial Sequence
  Description of Artificial Sequence: Synthetic expected off-target sequence
caaatgagagtcattacctgagg

SEQ ID NO: 2060 - DNA, 20 bp, Artificial Sequence
  Description of Artificial Sequence: Synthetic PCR primer
tcagtgcccctgggtcctca

SEQ ID NO: 2061 - DNA, 23 bp, Artificial Sequence
  Description of Artificial Sequence: Synthetic PCR primer
tgtgcaaatacctagcacggtgc

SEQ ID NO: 2062 - DNA, 23 bp, Artificial Sequence
  Description of Artificial Sequence: Synthetic expected off-target sequence
catgtctgaatcattacctgagg

SEQ ID NO: 2063 - DNA, 26 bp, Artificial Sequence
  Description of Artificial Sequence: Synthetic PCR primer
agcactcccttttgaattttggtgct

SEQ ID NO: 2064 - DNA, 26 bp, Artificial Sequence
  Description of Artificial Sequence: Synthetic PCR primer
actgaagtccagcctcttccatttca

SEQ ID NO: 2065 - DNA, 23 bp, Artificial Sequence
  Description of Artificial Sequence: Synthetic expected off-target sequence
cctgacttggtcattacctgtgg

SEQ ID NO: 2066 - DNA, 20 bp, Artificial Sequence
  Description of Artificial Sequence: Synthetic PCR primer
gaaaccggtccctggtgcca

SEQ ID NO: 2067 - DNA, 23 bp, Artificial Sequence
  Description of Artificial Sequence: Synthetic PCR primer
ggggagtagagggtagtgttgcc

SEQ ID NO: 2068 - DNA, 23 bp, Artificial Sequence
  Description of Artificial Sequence: Synthetic expected off-target sequence
cgtgcattagtcattacctgagg

SEQ ID NO: 2069 - DNA, 20 bp, Artificial Sequence
  Description of Artificial Sequence: Synthetic PCR primer
ttgcgggtccctgtggagtc

SEQ ID NO: 2070 - DNA, 20 bp, Artificial Sequence
  Description of Artificial Sequence: Synthetic PCR primer
aggtgccgtgttgtgcccaa

SEQ ID NO: 2071 - DNA, 23 bp, Artificial Sequence
  Description of Artificial Sequence: Synthetic expected off-target sequence
ggaatcccttctgcagcacctgg

SEQ ID NO: 2072 - DNA, 23 bp, Artificial Sequence
  Description of Artificial Sequence: Synthetic PCR primer
gccctacatctgctctccctcca

SEQ ID NO: 2073 - DNA, 20 bp, Artificial Sequence
  Description of Artificial Sequence: Synthetic PCR primer
gggccgggaaagagttgctg

SEQ ID NO: 2074 - DNA, 23 bp, Artificial Sequence
  Description of Artificial Sequence: Synthetic expected off-target sequence
ggaaccccgtctgcagcaccagg

SEQ ID NO: 2075 - DNA, 20 bp, Artificial Sequence
  Description of Artificial Sequence: Synthetic PCR primer
ttggagtgtggcccgggttg

SEQ ID NO: 2076 - DNA, 24 bp, Artificial Sequence
  Description of Artificial Sequence: Synthetic PCR primer
acctctctttctctgcctcactgt

SEQ ID NO: 2077 - DNA, 23 bp, Artificial Sequence
  Description of Artificial Sequence: Synthetic expected off-target sequence
ggaacaccttctgcagctccagg

SEQ ID NO: 2078 - DNA, 20 bp, Artificial Sequence
  Description of Artificial Sequence: Synthetic PCR primer
cacaccatgctgatccaggc

SEQ ID NO: 2079 - DNA, 20 bp, Artificial Sequence
  Description of Artificial Sequence: Synthetic PCR primer
gcagtacggaagcacgaagc

SEQ ID NO: 2080 - DNA, 23 bp, Artificial Sequence
  Description of Artificial Sequence: Synthetic expected off-target sequence
ggaagctctgctgcagcacctgg

SEQ ID NO: 2081 - DNA, 20 bp, Artificial Sequence
  Description of Artificial Sequence: Synthetic PCR primer
ctccagggctcgctgtccac

SEQ ID NO: 2082 - DNA, 20 bp, Artificial Sequence
  Description of Artificial Sequence: Synthetic PCR primer
ctgggctctgctggttcccc

SEQ ID NO: 2083 - DNA, 23 bp, Artificial Sequence
  Description of Artificial Sequence: Synthetic expected off-target sequence
ggaatatcttctgcagccccagg

SEQ ID NO: 2084 - DNA, 20 bp, Artificial Sequence
  Description of Artificial Sequence: Synthetic PCR primer
ctgtggtagccgtggccagg

SEQ ID NO: 2085 - DNA, 21 bp, Artificial Sequence
  Description of Artificial Sequence: Synthetic PCR primer
ccccataccacctctccggga

SEQ ID NO: 2086 - DNA, 23 bp, Artificial Sequence
  Description of Artificial Sequence: Synthetic expected off-target sequence
ggaatcacttttacagcaccagg

SEQ ID NO: 2087 - DNA, 20 bp, Artificial Sequence
  Description of Artificial Sequence: Synthetic PCR primer
ggtggcgggacttgaatgag

SEQ ID NO: 2088 - DNA, 20 bp, Artificial Sequence
  Description of Artificial Sequence: Synthetic PCR primer
ccagcgtgtttccaagggat

SEQ ID NO: 2089 - DNA, 23 bp, Artificial Sequence
  Description of Artificial Sequence: Synthetic expected off-target sequence
ggaatcccctctccagcccctgg

SEQ ID NO: 2090 - DNA, 20 bp, Artificial Sequence
  Description of Artificial Sequence: Synthetic PCR primer
ccagaggtggggccctgtga

SEQ ID NO: 2091 - DNA, 23 bp, Artificial Sequence
  Description of Artificial Sequence: Synthetic PCR primer
tttccacactcagttctgcagga

SEQ ID NO: 2092 - DNA, 23 bp, Artificial Sequence
  Description of Artificial Sequence: Synthetic expected off-target sequence
ggaatctcttcttcagcatctgg

SEQ ID NO: 2093 - DNA, 24 bp, Artificial Sequence
  Description of Artificial Sequence: Synthetic PCR primer
tgtgactggttgtcctgctttcct

SEQ ID NO: 2094 - DNA, 23 bp, Artificial Sequence
  Description of Artificial Sequence: Synthetic PCR primer
gcagtgttttgtggtgatgggca

SEQ ID NO: 2095 - DNA, 23 bp, Artificial Sequence
  Description of Artificial Sequence: Synthetic expected off-target sequence
ggaattgcttctgcagcgccagg

SEQ ID NO: 2096 - DNA, 20 bp, Artificial Sequence
  Description of Artificial Sequence: Synthetic PCR primer
ctggccaaggggtgagtggg

SEQ ID NO: 2097 - DNA, 20 bp, Artificial Sequence
  Description of Artificial Sequence: Synthetic PCR primer
tgggaccccagcagccaatg

SEQ ID NO: 2098 - DNA, 23 bp, Artificial Sequence
  Description of Artificial Sequence: Synthetic expected off-target sequence
ggactcccctctgcagcagctgg

SEQ ID NO: 2099 - DNA, 20 bp, Artificial Sequence
  Description of Artificial Sequence: Synthetic PCR primer
acggtgtgctggctgctctt

SEQ ID NO: 2100 - DNA, 20 bp, Artificial Sequence
  Description of Artificial Sequence: Synthetic PCR primer
acagtgctgaccgtgctggg

SEQ ID NO: 2101 - DNA, 23 bp, Artificial Sequence
  Description of Artificial Sequence: Synthetic expected off-target sequence
ggagtccctcctacagcaccagg

SEQ ID NO: 2102 - DNA, 21 bp, Artificial Sequence
  Description of Artificial Sequence: Synthetic PCR primer
tggtttgggcctcagggatgg

SEQ ID NO: 2103 - DNA, 24 bp, Artificial Sequence
  Description of Artificial Sequence: Synthetic PCR primer
tgcctcccacaaaaatgtctacct

SEQ ID NO: 2104 - DNA, 23 bp, Artificial Sequence
  Description of Artificial Sequence: Synthetic expected off-target sequence
ggagtccctcctacagcaccagg

SEQ ID NO: 2105 - DNA, 21 bp, Artificial Sequence
  Description of Artificial Sequence: Synthetic PCR primer
tggtttgggcctcagggatgg

SEQ ID NO: 2106 - DNA, 23 bp, Artificial Sequence
  Description of Artificial Sequence: Synthetic PCR primer
accccttatcccagaacccatga

SEQ ID NO: 2107 - DNA, 23 bp, Artificial Sequence
  Description of Artificial Sequence: Synthetic expected off-target sequence
ggcatccattctgcagcccctgg

SEQ ID NO: 2108 - DNA, 21 bp, Artificial Sequence
  Description of Artificial Sequence: Synthetic PCR primer
tccaagtcagcgatgagggct

SEQ ID NO: 2109 - DNA, 23 bp, Artificial Sequence
  Description of Artificial Sequence: Synthetic PCR primer
tgggagctgttcctttttggcca

SEQ ID NO: 2110 - DNA, 23 bp, Artificial Sequence
  Description of Artificial Sequence: Synthetic expected off-target sequence
ggcttcccttctgcagccccagg

SEQ ID NO: 2111 - DNA, 20 bp, Artificial Sequence
  Description of Artificial Sequence: Synthetic PCR primer
cacccctctcagcttcccaa

SEQ ID NO: 2112 - DNA, 20 bp, Artificial Sequence
  Description of Artificial Sequence: Synthetic PCR primer
gctagagggtctgctgcctt

SEQ ID NO: 2113 - DNA, 23 bp, Artificial Sequence
  Description of Artificial Sequence: Synthetic expected off-target sequence
tgaatcccatctccagcaccagg

SEQ ID NO: 2114 - DNA, 20 bp, Artificial Sequence
  Description of Artificial Sequence: Synthetic PCR primer
agaccccttggccaagcaca

SEQ ID NO: 2115 - DNA, 20 bp, Artificial Sequence
  Description of Artificial Sequence: Synthetic PCR primer
cttgctctcaccccgcctcc

SEQ ID NO: 2116 - DNA, 23 bp, Artificial Sequence
  Description of Artificial Sequence: Synthetic expected off-target sequence
aaaataccttctgcagtaccagg

SEQ ID NO: 2117 - DNA, 20 bp, Artificial Sequence
  Description of Artificial Sequence: Synthetic PCR primer
acatgtgggaggcggacaga

SEQ ID NO: 2118 - DNA, 25 bp, Artificial Sequence
  Description of Artificial Sequence: Synthetic PCR primer
tctcactttgctgttaccgatgtcg

SEQ ID NO: 2119 - DNA, 23 bp, Artificial Sequence
  Description of Artificial Sequence: Synthetic expected off-target sequence
aaaatcccttcttcaacacctgg

SEQ ID NO: 2120 - DNA, 20 bp, Artificial Sequence
  Description of Artificial Sequence: Synthetic PCR primer
ggacgactgtgcctgggaca

SEQ ID NO: 2121 - DNA, 24 bp, Artificial Sequence
  Description of Artificial Sequence: Synthetic PCR primer
agtgcccagagtgttgtaactgct

SEQ ID NO: 2122 - DNA, 23 bp, Artificial Sequence
  Description of Artificial Sequence: Synthetic expected off-target sequence
acactccctcctgcagcacctgg

SEQ ID NO: 2123 - DNA, 20 bp, Artificial Sequence
  Description of Artificial Sequence: Synthetic PCR primer
ggagagctcagcgccaggtc

SEQ ID NO: 2124 - DNA, 20 bp, Artificial Sequence
  Description of Artificial Sequence: Synthetic PCR primer
cagcgtggcccgtgggaata

SEQ ID NO: 2125 - DNA, 23 bp, Artificial Sequence
  Description of Artificial Sequence: Synthetic expected off-target sequence
accatccctcctgcagcaccagg

SEQ ID NO: 2126 - DNA, 21 bp, Artificial Sequence
  Description of Artificial Sequence: Synthetic PCR primer
gctgaagtgctctggggtgct

SEQ ID NO: 2127 - DNA, 25 bp, Artificial Sequence
  Description of Artificial Sequence: Synthetic PCR primer
accccactgtggatgaattggtacc

SEQ ID NO: 2128 - DNA, 23 bp, Artificial Sequence
  Description of Artificial Sequence: Synthetic expected off-target sequence
agaggcccctctgcagcaccagg

SEQ ID NO: 2129 - DNA, 20 bp, Artificial Sequence
  Description of Artificial Sequence: Synthetic PCR primer
tcggggtgcacatggccatc

SEQ ID NO: 2130 - DNA, 20 bp, Artificial Sequence
  Description of Artificial Sequence: Synthetic PCR primer
ttgcctcgcaggggaagcag

SEQ ID NO: 2131 - DNA, 23 bp, Artificial Sequence
  Description of Artificial Sequence: Synthetic expected off-target sequence
aggatcccttgtgcagctcctgg

SEQ ID NO: 2132 - DNA, 20 bp, Artificial Sequence
  Description of Artificial Sequence: Synthetic PCR primer
ctcgtgggaggccaacacct

SEQ ID NO: 2133 - DNA, 22 bp, Artificial Sequence
  Description of Artificial Sequence: Synthetic PCR primer
agccaccaacacataccaggct

SEQ ID NO: 2134 - DNA, 23 bp, Artificial Sequence
  Description of Artificial Sequence: Synthetic expected off-target sequence
ccactcctttctgcagcacccgg

SEQ ID NO: 2135 - DNA, 20 bp, Artificial Sequence
  Description of Artificial Sequence: Synthetic PCR primer
gcatgcctttaatcccggct

SEQ ID NO: 2136 - DNA, 22 bp, Artificial Sequence
  Description of Artificial Sequence: Synthetic PCR primer
aggatttcagagtgatggggct

SEQ ID NO: 2137 - DNA, 23 bp, Artificial Sequence
  Description of Artificial Sequence: Synthetic expected off-target sequence
gaaggcccttcagcagcacctgg

SEQ ID NO: 2138 - DNA, 20 bp, Artificial Sequence
  Description of Artificial Sequence: Synthetic PCR primer
cgcccagccacaaagtgcat

SEQ ID NO: 2139 - DNA, 27 bp, Artificial Sequence
  Description of Artificial Sequence: Synthetic PCR primer
gcaaatttctgcacctactctaggcct

SEQ ID NO: 2140 - DNA, 23 bp, Artificial Sequence
  Description of Artificial Sequence: Synthetic expected off-target sequence
gatatcccttctgtatcacctgg

SEQ ID NO: 2141 - DNA, 26 bp, Artificial Sequence
  Description of Artificial Sequence: Synthetic PCR primer
agctcacaagaattggaggtaacagt

SEQ ID NO: 2142 - DNA, 22 bp, Artificial Sequence
  Description of Artificial Sequence: Synthetic PCR primer
gcagtcacccttcactgcctgt

SEQ ID NO: 2143 - DNA, 23 bp, Artificial Sequence
  Description of Artificial Sequence: Synthetic expected off-target sequence
gggtccgcttctgcagcacctgg

SEQ ID NO: 2144 - DNA, 20 bp, Artificial Sequence
  Description of Artificial Sequence: Synthetic PCR primer
aaactgggctgggcttccgg

SEQ ID NO: 2145 - DNA, 23 bp, Artificial Sequence
  Description of Artificial Sequence: Synthetic PCR primer
ggggctaaggcattgtcagaccc

SEQ ID NO: 2146 - DNA, 23 bp, Artificial Sequence
  Description of Artificial Sequence: Synthetic expected off-target sequence
gtctccccttctgcagcaccagg

SEQ ID NO: 2147 - DNA, 20 bp, Artificial Sequence
  Description of Artificial Sequence: Synthetic PCR primer
gcaggtaggcagtctggggc

SEQ ID NO: 2148 - DNA, 20 bp, Artificial Sequence
  Description of Artificial Sequence: Synthetic PCR primer
tctcctgcctcagcctccca

SEQ ID NO: 2149 - DNA, 23 bp, Artificial Sequence
  Description of Artificial Sequence: Synthetic expected off-target sequence
gtctccccttctgcagcaccagg

SEQ ID NO: 2150 - DNA, 20 bp, Artificial Sequence
  Description of Artificial Sequence: Synthetic PCR primer
gcaggtaggcagtctggggc

SEQ ID NO: 2151 - DNA, 20 bp, Artificial Sequence
  Description of Artificial Sequence: Synthetic PCR primer
tctcctgcctcagcctccca

SEQ ID NO: 2152 - DNA, 23 bp, Artificial Sequence
  Description of Artificial Sequence: Synthetic expected off-target sequence
gtctccccttctgcagcaccagg

SEQ ID NO: 2153 - DNA, 20 bp, Artificial Sequence
  Description of Artificial Sequence: Synthetic PCR primer
gcaggtaggcagtctggggc

SEQ ID NO: 2154 - DNA, 20 bp, Artificial Sequence
  Description of Artificial Sequence: Synthetic PCR primer
tctcctgcctcagcctccca

SEQ ID NO: 2155 - DNA, 23 bp, Artificial Sequence
  Description of Artificial Sequence: Synthetic expected off-target sequence
tcattcccgtctgcagcacccgg

SEQ ID NO: 2156 - DNA, 20 bp, Artificial Sequence
  Description of Artificial Sequence: Synthetic PCR primer
gctctggggtagaaggaggc

SEQ ID NO: 2157 - DNA, 20 bp, Artificial Sequence
  Description of Artificial Sequence: Synthetic PCR primer
ggcctgtcaaccaaccaacc

SEQ ID NO: 2158 - DNA, 23 bp, Artificial Sequence
  Description of Artificial Sequence: Synthetic expected off-target sequence
tgcacccctcctgcagcaccagg

SEQ ID NO: 2159 - DNA, 20 bp, Artificial Sequence
  Description of Artificial Sequence: Synthetic PCR primer
tgacatgttgtgtgctgggc

SEQ ID NO: 2160 - DNA, 20 bp, Artificial Sequence
  Description of Artificial Sequence: Synthetic PCR primer
aaatcctgcagcctcccctt

SEQ ID NO: 2161 - DNA, 23 bp, Artificial Sequence
  Description of Artificial Sequence: Synthetic expected off-target sequence
tgcataccctctgcagcaccagg

SEQ ID NO: 2162 - DNA, 23 bp, Artificial Sequence
  Description of Artificial Sequence: Synthetic PCR primer
tcctggtgagatcgtccacagga

SEQ ID NO: 2163 - DNA, 20 bp, Artificial Sequence
  Description of Artificial Sequence: Synthetic PCR primer
tcctccccactcagcctccc

SEQ ID NO: 2164 - DNA, 23 bp, Artificial Sequence
  Description of Artificial Sequence: Synthetic expected off-target sequence
tgcatggcttctgcagcaccagg

SEQ ID NO: 2165 - DNA, 27 bp, Artificial Sequence
  Description of Artificial Sequence: Synthetic PCR primer
tcctaatccaagtcctttgttcagaca

SEQ ID NO: 2166 - DNA, 22 bp, Artificial Sequence
  Description of Artificial Sequence: Synthetic PCR primer
agggaccagccactacccttca

SEQ ID NO: 2167 - DNA, 23 bp, Artificial Sequence
  Description of Artificial Sequence: Synthetic expected off-target sequence
aatattccctctgcagcaccagg

SEQ ID NO: 2168 - DNA, 20 bp, Artificial Sequence
  Description of Artificial Sequence: Synthetic PCR primer
gggacaccagttccttccat

SEQ ID NO: 2169 - DNA, 20 bp, Artificial Sequence
  Description of Artificial Sequence: Synthetic PCR primer
gggggagattggagttcccc

SEQ ID NO: 2170 - DNA, 23 bp, Artificial Sequence
  Description of Artificial Sequence: Synthetic expected off-target sequence
accatttcttctgcagcacctgg

SEQ ID NO: 2171 - DNA, 25 bp, Artificial Sequence
  Description of Artificial Sequence: Synthetic PCR primer
acaccactatcaaggcagagtaggt

SEQ ID NO: 2172 - DNA, 20 bp, Artificial Sequence
  Description of Artificial Sequence: Synthetic PCR primer
tctgcctggggtgctttccc

SEQ ID NO: 2173 - DNA, 23 bp, Artificial Sequence
  Description of Artificial Sequence: Synthetic expected off-target sequence
agctcccattctgcagcacccgg

SEQ ID NO: 2174 - DNA, 20 bp, Artificial Sequence
  Description of Artificial Sequence: Synthetic PCR primer
ctgggagcggagggaagtgc

SEQ ID NO: 2175 - DNA, 20 bp, Artificial Sequence
  Description of Artificial Sequence: Synthetic PCR primer
gccccgacagatgaggcctc

SEQ ID NO: 2176 - DNA, 23 bp, Artificial Sequence
  Description of Artificial Sequence: Synthetic expected off-target sequence
cagattcctgctgcagcaccggg

SEQ ID NO: 2177 - DNA, 20 bp, Artificial Sequence
  Description of Artificial Sequence: Synthetic PCR primer
cgggtctcggaatgcctcca

SEQ ID NO: 2178 - DNA, 20 bp, Artificial Sequence
  Description of Artificial Sequence: Synthetic PCR primer
acccaggaattgccaccccc

SEQ ID NO: 2179 - DNA, 23 bp, Artificial Sequence
  Description of Artificial Sequence: Synthetic expected off-target sequence
ccaagagcttctgcagcacctgg

SEQ ID NO: 2180 - DNA, 20 bp, Artificial Sequence
  Description of Artificial Sequence: Synthetic PCR primer
ttgctgtggtcccggtggtg

SEQ ID NO: 2181 - DNA, 20 bp, Artificial Sequence
  Description of Artificial Sequence: Synthetic PCR primer
gcagacactagagcccgccc

SEQ ID NO: 2182 - DNA, 23 bp, Artificial Sequence
  Description of Artificial Sequence: Synthetic expected off-target sequence
cccagccctgctgcagcacccgg

SEQ ID NO: 2183 - DNA, 20 bp, Artificial Sequence
  Description of Artificial Sequence: Synthetic PCR primer
ggtgtggtgacaggtcgggt

SEQ ID NO: 2184 - DNA, 20 bp, Artificial Sequence
  Description of Artificial Sequence: Synthetic PCR primer
acctgcgtctctgtgctgca

SEQ ID NO: 2185 - DNA, 23 bp, Artificial Sequence
  Description of Artificial Sequence: Synthetic expected off-target sequence
cccctccctcctgcagcaccggg

SEQ ID NO: 2186 - DNA, 20 bp, Artificial Sequence
  Description of Artificial Sequence: Synthetic PCR primer
ctcccaggacagtgctcggc

SEQ ID NO: 2187 - DNA, 19 bp, Artificial Sequence
  Description of Artificial Sequence: Synthetic PCR primer
cctggccccatgctgcctg

SEQ ID NO: 2188 - DNA, 23 bp, Artificial Sequence
  Description of Artificial Sequence: Synthetic expected off-target sequence
ctactgacttctgcagcacctgg

SEQ ID NO: 2189 - DNA, 22 bp, Artificial Sequence
  Description of Artificial Sequence: Synthetic PCR primer
tgcgtaggttttgcctctgtga

SEQ ID NO: 2190 - DNA, 24 bp, Artificial Sequence
  Description of Artificial Sequence: Synthetic PCR primer
agggaatgatgttttccaccccct

SEQ ID NO: 2191 - DNA, 23 bp, Artificial Sequence
  Description of Artificial Sequence: Synthetic expected off-target sequence
ctcctccctcctgcagcacctgg

SEQ ID NO: 2192 - DNA, 20 bp, Artificial Sequence
  Description of Artificial Sequence: Synthetic PCR primer
ctccgcagccaccgttggta

SEQ ID NO: 2193 - DNA, 22 bp, Artificial Sequence
  Description of Artificial Sequence: Synthetic PCR primer
tgcattgacgtacgatggctca

SEQ ID NO: 2194 - DNA, 23 bp, Artificial Sequence
  Description of Artificial Sequence: Synthetic expected off-target sequence
tctgtccctcctgcagcacctgg

SEQ ID NO: 2195 - DNA, 22 bp, Artificial Sequence
  Description of Artificial Sequence: Synthetic PCR primer
acctgcagcatgaactctcgca

SEQ ID NO: 2196 - DNA, 24 bp, Artificial Sequence
  Description of Artificial Sequence: Synthetic PCR primer
acctgagcaacatgactcacctgg

SEQ ID NO: 2197 - DNA, 23 bp, Artificial Sequence
  Description of Artificial Sequence: Synthetic expected off-target sequence
acacaaacttctgcagcacctgg

SEQ ID NO: 2198 - DNA, 23 bp, Artificial Sequence
  Description of Artificial Sequence: Synthetic PCR primer
tctccagtttcttgctctcatgg

SEQ ID NO: 2199 - DNA, 20 bp, Artificial Sequence
  Description of Artificial Sequence: Synthetic PCR primer
accattggtgaacccagtca

SEQ ID NO: 2200 - DNA, 23 bp, Artificial Sequence
  Description of Artificial Sequence: Synthetic expected off-target sequence
actgtcatttctgcagcacctgg

SEQ ID NO: 2201 - DNA, 22 bp, Artificial Sequence
  Description of Artificial Sequence: Synthetic PCR primer
tggggtggtggtcttgaatcca

SEQ ID NO: 2202 - DNA, 25 bp, Artificial Sequence
  Description of Artificial Sequence: Synthetic PCR primer
tcagctataacctgggacttgtgct

SEQ ID NO: 2203 - DNA, 23 bp, Artificial Sequence
  Description of Artificial Sequence: Synthetic expected off-target sequence
actttatcttctgcagcacctgg

SEQ ID NO: 2204 - DNA, 21 bp, Artificial Sequence
  Description of Artificial Sequence: Synthetic PCR primer
agcagccagtccagtgtcctg

SEQ ID NO: 2205 - DNA, 23 bp, Artificial Sequence
  Description of Artificial Sequence: Synthetic PCR primer
ccctttcatcgagaaccccaggg

SEQ ID NO: 2206 - DNA, 23 bp, Artificial Sequence
  Description of Artificial Sequence: Synthetic expected off-target sequence
atcctttcttctgcagcacctgg

SEQ ID NO: 2207 - DNA, 20 bp, Artificial Sequence
  Description of Artificial Sequence: Synthetic PCR primer
tggacgctgctgggaggaga

SEQ ID NO: 2208 - DNA, 20 bp, Artificial Sequence
  Description of Artificial Sequence: Synthetic PCR primer
gaggtctcgggctgctcgtg

SEQ ID NO: 2209 - DNA, 23 bp, Artificial Sequence
  Description of Artificial Sequence: Synthetic expected off-target sequence
caccaccgttctgcagcaccagg

SEQ ID NO: 2210 - DNA, 22 bp, Artificial Sequence
  Description of Artificial Sequence: Synthetic PCR primer
aggtttgcactctgttgcctgg

SEQ ID NO: 2211 - DNA, 21 bp, Artificial Sequence
  Description of Artificial Sequence: Synthetic PCR primer
tggggtgattggttgccaggt

SEQ ID NO: 2212 - DNA, 23 bp, Artificial Sequence
  Description of Artificial Sequence: Synthetic expected off-target sequence
catgtggcttctgcagcacctgg

SEQ ID NO: 2213 - DNA, 22 bp, Artificial Sequence
  Description of Artificial Sequence: Synthetic PCR primer
tcttcctttgccaggcagcaca

SEQ ID NO: 2214 - DNA, 25 bp, Artificial Sequence
  Description of Artificial Sequence: Synthetic PCR primer
tgcaggaatagcaggtatgaggagt

SEQ ID NO: 2215 - DNA, 23 bp, Artificial Sequence
  Description of Artificial Sequence: Synthetic expected off-target sequence
cattttctttctgcagcacctgg

SEQ ID NO: 2216 - DNA, 20 bp, Artificial Sequence
  Description of Artificial Sequence: Synthetic PCR primer
ggacgcctactgcctggacc

SEQ ID NO: 2217 - DNA, 20 bp, Artificial Sequence
  Description of Artificial Sequence: Synthetic PCR primer
gccctggcagcccatggtac

SEQ ID NO: 2218 - DNA, 23 bp, Artificial Sequence
  Description of Artificial Sequence: Synthetic expected off-target sequence
ctctgtccttctgcagcacctgg

SEQ ID NO: 2219 - DNA, 20 bp, Artificial Sequence
  Description of Artificial Sequence: Synthetic PCR primer
aggcagtcatcgccttgcta

SEQ ID NO: 2220 - DNA, 20 bp, Artificial Sequence
  Description of Artificial Sequence: Synthetic PCR primer
ggtcccaccttcccctacaa

SEQ ID NO: 2221 - DNA, 23 bp, Artificial Sequence
  Description of Artificial Sequence: Synthetic expected off-target sequence
ctgtaccctcctgcagcaccagg

SEQ ID NO: 2222 - DNA, 23 bp, Artificial Sequence
  Description of Artificial Sequence: Synthetic expected off-target sequence
ttgaggccgtctgcagcaccggg

SEQ ID NO: 2223 - DNA, 20 bp, Artificial Sequence
  Description of Artificial Sequence: Synthetic PCR primer
ccccagcccccaccagtttc

SEQ ID NO: 2224 - DNA, 20 bp, Artificial Sequence
  Description of Artificial Sequence: Synthetic PCR primer
cagcccaggccacagcttca

SEQ ID NO: 2225 - DNA, 23 bp, Artificial Sequence
  Description of Artificial Sequence: Synthetic actual target site sequence
gggtgattgaagtttgctccagg

SEQ ID NO: 2226 - DNA, 23 bp, Artificial Sequence
  Description of Artificial Sequence: Synthetic actual target site sequence
gggtgattgaagtttgctgcagg

SEQ ID NO: 2227 - DNA, 23 bp, Artificial Sequence
  Description of Artificial Sequence: Synthetic actual target site sequence
ctctccccccaccccccctctgg

SEQ ID NO: 2228 - DNA, 22 bp, Artificial Sequence
  Description of Artificial Sequence: Synthetic actual target site sequence
atttcctcccccccccctcagg

SEQ ID NO: 2229 - DNA, 23 bp, Artificial Sequence
  Description of Artificial Sequence: Synthetic actual target site sequence
aagacagaggagaagaagaaggg

SEQ ID NO: 2230 - DNA, 23 bp, Artificial Sequence
  Description of Artificial Sequence: Synthetic actual target site sequence
tcattgyagcagaagaagaaagg

SEQ ID NO: 2231 - DNA, 23 bp, Artificial Sequence
  Description of Artificial Sequence: Synthetic actual target site sequence
ggtatctaagtcattacctgtgg

SEQ ID NO: 2232 - DNA, 23 bp, Artificial Sequence
  Description of Artificial Sequence: Synthetic actual target site sequence
ggtatctaagtcaatacctgtgg

SEQ ID NO: 2233 - DNA, 23 bp, Artificial Sequence
  Description of Artificial Sequence: Synthetic actual target site sequence
tccatctcactcattacctgagg

SEQ ID NO: 2234 - DNA, 23 bp, Artificial Sequence
  Description of Artificial Sequence: Synthetic actual target site sequence
tccatctcactcattacctgatg

SEQ ID NO: 2235 - DNA, 23 bp, Artificial Sequence
  Description of Artificial Sequence: Synthetic actual target site sequence
tttatattagtgattacctgcgg

SEQ ID NO: 2236 - DNA, 23 bp, Artificial Sequence
  Description of Artificial Sequence: Synthetic actual target site sequence
ggaatcccctctccagcccctgg

SEQ ID NO: 2237 - DNA, 23 bp, Artificial Sequence
  Description of Artificial Sequence: Synthetic actual target site sequence
ggaatcccctctccagcctctgg

SEQ ID NO: 2238 - DNA, 23 bp, Artificial Sequence
  Description of Artificial Sequence: Synthetic actual target site sequence
ggaatctcttccttggcatctgg

SEQ ID NO: 2239 - DNA, 23 bp, Artificial Sequence
  Description of Artificial Sequence: Synthetic actual target site sequence
cagattactgctgcagcaccggg

SEQ ID NO: 2240 - DNA, 23 bp, Artificial Sequence
  Description of Artificial Sequence: Synthetic actual target site sequence
acacaaacttctgcagcacstgg

SEQ ID NO: 2241 - DNA, 23 bp, Artificial Sequence
  Description of Artificial Sequence: Synthetic target site sequence in EGFP reporter gene
ggcgagggcgatgccacctacgg

SEQ ID NO: 2242 - DNA, 23 bp, Artificial Sequence
  Description of Artificial Sequence: Synthetic standard RGN on-target sequence
gggtggggggagtttgctcctgg

SEQ ID NO: 2243 - DNA, 21 bp, Artificial Sequence
  Description of Artificial Sequence: Synthetic truncated RGN on-target sequence
gtggggggagtttgctcctgg

SEQ ID NO: 2244 - DNA, 23 bp, Artificial Sequence
  Description of Artificial Sequence: Synthetic standard RGN off-target sequence
ggatggagggagtttgctcctgg

SEQ ID NO: 2245 - DNA, 21 bp, Artificial Sequence
  Description of Artificial Sequence: Synthetic truncated RGN off-target sequence
atggagggagtttgctcctgg

SEQ ID NO: 2246 - DNA, 23 bp, Artificial Sequence
  Description of Artificial Sequence: Synthetic standard RGN off-target sequence
gggagggtggagtttgctcctgg

SEQ ID NO: 2247 - DNA, 21 bp, Artificial Sequence
  Description of Artificial Sequence: Synthetic truncated RGN off-target sequence
gagggtggagtttgctcctgg

SEQ ID NO: 2248 - DNA, 23 bp, Artificial Sequence
  Description of Artificial Sequence: Synthetic standard RGN off-target sequence
cgggggagggagtttgctcctgg

SEQ ID NO: 2249 - DNA, 21 bp, Artificial Sequence
  Description of Artificial Sequence: Synthetic truncated RGN off-target sequence
ggggagggagtttgctcctgg

SEQ ID NO: 2250 - DNA, 23 bp, Artificial Sequence
  Description of Artificial Sequence: Synthetic standard RGN off-target sequence
ggggaggggaagtttgctcctgg

SEQ ID NO: 2251 - DNA, 21 bp, Artificial Sequence
  Description of Artificial Sequence: Synthetic truncated RGN off-target sequence
ggaggggaagtttgctcctgg

SEQ ID NO: 2252 - DNA, 23 bp, Artificial Sequence
  Description of Artificial Sequence: Synthetic standard RGN on-target sequence
ggtgagtgagtgtgtgcgtgtgg

SEQ ID NO: 2253 - DNA, 20 bp, Artificial Sequence
  Description of Artificial Sequence: Synthetic truncated RGN on-target sequence
gagtgagtgtgtgcgtgtgg

SEQ ID NO: 2254 - DNA, 23 bp, Artificial Sequence
  Description of Artificial Sequence: Synthetic standard RGN off-target sequence
ggtgagtgagtgtgtgtgtgagg

SEQ ID NO: 2255 - DNA, 20 bp, Artificial Sequence
  Description of Artificial Sequence: Synthetic truncated RGN off-target sequence
gagtgagtgtgtgtgtgagg

SEQ ID NO: 2256 - DNA, 23 bp, Artificial Sequence
  Description of Artificial Sequence: Synthetic standard RGN off-target sequence
agtgagtgagtgtgtgtgtgggg

SEQ ID NO: 2257 - DNA, 20 bp, Artificial Sequence
  Description of Artificial Sequence: Synthetic truncated RGN off-target sequence
gagtgagtgtgtgtgtgggg

SEQ ID NO: 2258 - DNA, 23 bp, Artificial Sequence
  Description of Artificial Sequence: Synthetic standard RGN off-target sequence
gctgagtgagtgtatgcgtgtgg

SEQ ID NO: 2259 - DNA, 20 bp, Artificial Sequence
  Description of Artificial Sequence: Synthetic truncated RGN off-target sequence
gagtgagtgtatgcgtgtgg

SEQ ID NO: 2260 - DNA, 23 bp, Artificial Sequence
  Description of Artificial Sequence: Synthetic standard RGN off-target sequence
ggtgagtgagtgcgtgcgggtgg

SEQ ID NO: 2261 - DNA, 20 bp, Artificial Sequence
  Description of Artificial Sequence: Synthetic truncated RGN off-target sequence
gagtgagtgcgtgcgggtgg

SEQ ID NO: 2262 - DNA, 23 bp, Artificial Sequence
  Description of Artificial Sequence: Synthetic standard RGN off-target sequence
gttgagtgaatgtgtgcgtgagg

SEQ ID NO: 2263 - DNA, 20 bp, Artificial Sequence
  Description of Artificial Sequence: Synthetic truncated RGN off-target sequence
gagtgaatgtgtgcgtgagg

SEQ ID NO: 2264 - DNA, 23 bp, Artificial Sequence
  Description of Artificial Sequence: Synthetic standard RGN off-target sequence
tgtgggtgagtgtgtgcgtgagg

SEQ ID NO: 2265 - DNA, 20 bp, Artificial Sequence
  Description of Artificial Sequence: Synthetic truncated RGN off-target sequence
gggtgagtgtgtgcgtgagg

SEQ ID NO: 2266 - DNA, 23 bp, Artificial Sequence
  Description of Artificial Sequence: Synthetic standard RGN off-target sequence
agagagtgagtgtgtgcatgagg

SEQ ID NO: 2267 - DNA, 20 bp, Artificial Sequence
  Description of Artificial Sequence: Synthetic truncated RGN off-target sequence
gagtgagtgtgtgcatgagg

SEQ ID NO: 2268 - DNA, 23 bp, Artificial Sequence
  Description of Artificial Sequence: Synthetic standard RGN on-target sequence
gagtccgagcagaagaagaaggg

SEQ ID NO: 2269 - DNA, 21 bp, Artificial Sequence
  Description of Artificial Sequence: Synthetic truncated RGN on-target sequence
gtccgagcagaagaagaaggg

SEQ ID NO: 2270 - DNA, 23 bp, Artificial Sequence
  Description of Artificial Sequence: Synthetic standard RGN off-target sequence
gagttagagcagaagaagaaagg

SEQ ID NO: 2271 - DNA, 21 bp, Artificial Sequence
  Description of Artificial Sequence: Synthetic truncated RGN off-target sequence
gttagagcagaagaagaaagg

SEQ ID NO: 2272 - DNA, 23 bp, Artificial Sequence
  Description of Artificial Sequence: Synthetic standard RGN off-target sequence
gagtctaagcagaagaagaagag

SEQ ID NO: 2273 - DNA, 21 bp, Artificial Sequence
  Description of Artificial Sequence: Synthetic truncated RGN off-target sequence
gtctaagcagaagaagaagag

SEQ ID NO: 2274 - DNA, 21 bp, Artificial Sequence
  Description of Artificial Sequence: Synthetic truncated RGN on-target sequence + PAM for VEGFA
gtggggggagtttgctcctgg

SEQ ID NO: 2275 - DNA, 21 bp, Artificial Sequence
  Description of Artificial Sequence: Synthetic potential truncated RGN off-target sequence + PAM for VEGFA
gtggggggagtttgccccagg

SEQ ID NO: 2276 - DNA, 21 bp, Artificial Sequence
  Description of Artificial Sequence: Synthetic potential truncated RGN off-target sequence + PAM for VEGFA
gtggggggtgtttgctcccgg

SEQ ID NO: 2277 - DNA, 21 bp, Artificial Sequence
  Description of Artificial Sequence: Synthetic potential truncated RGN off-target sequence + PAM for VEGFA
gtgggtggagtttgctactgg

SEQ ID NO: 2278 - DNA, 21 bp, Artificial Sequence
  Description of Artificial Sequence: Synthetic potential truncated RGN off-target sequence + PAM for VEGFA
gtggggggagctttctcctgg

SEQ ID NO: 2279 - DNA, 21 bp, Artificial Sequence
  Description of Artificial Sequence: Synthetic potential truncated RGN off-target sequence + PAM for VEGFA
gtgggtggcgtttgctccagg

SEQ ID NO: 2280 - DNA, 21 bp, Artificial Sequence
  Description of Artificial Sequence: Synthetic potential truncated RGN off-target sequence + PAM for VEGFA
gtggagggagcttgctcctgg

SEQ ID NO: 2281 - DNA, 21 bp, Artificial Sequence
  Description of Artificial Sequence: Synthetic potential truncated RGN off-target sequence + PAM for VEGFA
gtgggtggagtttgctacagg

SEQ ID NO: 2282 - DNA, 21 bp, Artificial Sequence
  Description of Artificial Sequence: Synthetic potential truncated RGN off-target sequence + PAM for VEGFA
gggggggcagtttgctcctgg

SEQ ID NO: 2283 - DNA, 21 bp, Artificial Sequence
  Description of Artificial Sequence: Synthetic potential truncated RGN off-target sequence + PAM for VEGFA
gtgtggggaatttgctccagg

SEQ ID NO: 2284 - DNA, 21 bp, Artificial Sequence
  Description of Artificial Sequence: Synthetic potential truncated RGN off-target sequence + PAM for VEGFA
ctgctgggagtttgctcctgg

SEQ ID NO: 2285 - DNA, 21 bp, Artificial Sequence
  Description of Artificial Sequence: Synthetic potential truncated RGN off-target sequence + PAM for VEGFA
tttgggagagtttgctccagg

SEQ ID NO: 2286 - DNA, 21 bp, Artificial Sequence
  Description of Artificial Sequence: Synthetic potential truncated RGN off-target sequence + PAM for VEGFA
ctgagggcagtttgctccagg

SEQ ID NO: 2287 - DNA, 21 bp, Artificial Sequence
  Description of Artificial Sequence: Synthetic potential truncated RGN off-target sequence + PAM for VEGFA
gtaagggaagtttgctcctgg

SEQ ID NO: 2288 - DNA, 21 bp, Artificial Sequence
  Description of Artificial Sequence: Synthetic potential truncated RGN off-target sequence + PAM for VEGFA
gggggtagagtttgctccagg

SEQ ID NO: 2289 - DNA, 21 bp, Artificial Sequence
  Description of Artificial Sequence: Synthetic potential truncated RGN off-target sequence + PAM for VEGFA
gggtggggactttgctccagg

SEQ ID NO: 2290 - DNA, 21 bp, Artificial Sequence
  Description of Artificial Sequence: Synthetic potential truncated RGN off-target sequence + PAM for VEGFA
gggggagcagtttgctccagg

SEQ ID NO: 2291 - DNA, 21 bp, Artificial Sequence
  Description of Artificial Sequence: Synthetic potential truncated RGN off-target sequence + PAM for VEGFA
ttggggttagtttgctcctgg

SEQ ID NO: 2292 - DNA, 21 bp, Artificial Sequence
  Description of Artificial Sequence: Synthetic potential truncated RGN off-target sequence + PAM for VEGFA
ttgaggggagtctgctccagg

SEQ ID NO: 2293 - DNA, 21 bp, Artificial Sequence
  Description of Artificial Sequence: Synthetic potential truncated RGN off-target sequence + PAM for VEGFA
ctggggtgattttgctcctgg

SEQ ID NO: 2294 - DNA, 21 bp, Artificial Sequence
  Description of Artificial Sequence: Synthetic potential truncated RGN off-target sequence + PAM for VEGFA
gagaggggagttggctcctgg

SEQ ID NO: 2295 - DNA, 21 bp, Artificial Sequence
  Description of Artificial Sequence: Synthetic potential truncated RGN off-target sequence + PAM for VEGFA
tttgggggagtttgccccagg

SEQ ID NO: 2296 - DNA, 21 bp, Artificial Sequence
  Description of Artificial Sequence: Synthetic potential truncated RGN off-target sequence + PAM for VEGFA
ttcgggggagtttgcgccggg

SEQ ID NO: 2297 - DNA, 21 bp, Artificial Sequence
  Description of Artificial Sequence: Synthetic potential truncated RGN off-target sequence + PAM for VEGFA
ctcgggggagtttgcaccagg

SEQ ID NO: 2298 - DNA, 21 bp, Artificial Sequence
  Description of Artificial Sequence: Synthetic potential truncated RGN off-target sequence + PAM for VEGFA
gtgttgggagtctgctccagg

SEQ ID NO: 2299 - DNA, 21 bp, Artificial Sequence
  Description of Artificial Sequence: Synthetic potential truncated RGN off-target sequence + PAM for VEGFA
gagggggcaggttgctccagg

SEQ ID NO: 2300 - DNA, 21 bp, Artificial Sequence
  Description of Artificial Sequence: Synthetic potential truncated RGN off-target sequence + PAM for VEGFA
gaggggagagtttgttccagg

SEQ ID NO: 2301 - DNA, 21 bp, Artificial Sequence
  Description of Artificial Sequence: Synthetic potential truncated RGN off-target sequence + PAM for VEGFA
gtggctggagtttgctgctgg

SEQ ID NO: 2302 - DNA, 21 bp, Artificial Sequence
  Description of Artificial Sequence: Synthetic potential truncated RGN off-target sequence + PAM for VEGFA
gtcgggggagtgggctccagg

SEQ ID NO: 2303 - DNA, 21 bp, Artificial Sequence
  Description of Artificial Sequence: Synthetic potential truncated RGN off-target sequence + PAM for VEGFA
gaggggggagtgtgttccggg

SEQ ID NO: 2304 - DNA, 21 bp, Artificial Sequence
  Description of Artificial Sequence: Synthetic potential truncated RGN off-target sequence + PAM for VEGFA
gtggtgggagcttgttcctgg

SEQ ID NO: 2305 - DNA, 21 bp, Artificial Sequence
  Description of Artificial Sequence: Synthetic potential truncated RGN off-target sequence + PAM for VEGFA
gtggggggtgcctgctccagg

SEQ ID NO: 2306 - DNA, 20 bp, Artificial Sequence
  Description of Artificial Sequence: Synthetic truncated RGN on-target sequence + PAM for VEGFA
gagtgagtgtgtgcgtgtgg

SEQ ID NO: 2307 - DNA, 20 bp, Artificial Sequence
  Description of Artificial Sequence: Synthetic potential truncated RGN off-target sequence + PAM for VEGFA
cagtgagtgtgtgcgtgtgg

SEQ ID NO: 2308 - DNA, 20 bp, Artificial Sequence
  Description of Artificial Sequence: Synthetic potential truncated RGN off-target sequence + PAM for VEGFA
gtgtgagtgtgtgcgtgggg

SEQ ID NO: 2309 - DNA, 20 bp, Artificial Sequence
  Description of Artificial Sequence: Synthetic potential truncated RGN off-target sequence + PAM for VEGFA
gtgtgagtgtgtgcgtgagg

SEQ ID NO: 2310 - DNA, 20 bp, Artificial Sequence
  Description of Artificial Sequence: Synthetic potential truncated RGN off-target sequence + PAM for VEGFA
gtgtgagtgtgtgcgtgtgg

SEQ ID NO: 2311 - DNA, 20 bp, Artificial Sequence
  Description of Artificial Sequence: Synthetic potential truncated RGN off-target sequence + PAM for VEGFA
gagtgtgtgtgtgcgtgtgg

SEQ ID NO: 2312 - DNA, 20 bp, Artificial Sequence
  Description of Artificial Sequence: Synthetic potential truncated RGN off-target sequence + PAM for VEGFA
gagtgggtgtgtgcgtgggg

SEQ ID NO: 2313 - DNA, 20 bp, Artificial Sequence
  Description of Artificial Sequence: Synthetic potential truncated RGN off-target sequence + PAM for VEGFA
gagtgactgtgtgcgtgtgg

SEQ ID NO: 2314 - DNA, 20 bp, Artificial Sequence
  Description of Artificial Sequence: Synthetic potential truncated RGN off-target sequence + PAM for VEGFA
gagtgagtgtgtgggtgggg

SEQ ID NO: 2315 - DNA, 20 bp, Artificial Sequence
  Description of Artificial Sequence: Synthetic potential truncated RGN off-target sequence + PAM for VEGFA
gagtgagtgtgtgtgtgtgg

SEQ ID NO: 2316 - DNA, 20 bp, Artificial Sequence
  Description of Artificial Sequence: Synthetic potential truncated RGN off-target sequence + PAM for VEGFA
gagtgagtgtgtgtgtgtgg

SEQ ID NO: 2317 - DNA, 20 bp, Artificial Sequence
  Description of Artificial Sequence: Synthetic potential truncated RGN off-target sequence + PAM for VEGFA
gagtgagtgtgtgtgtgggg

SEQ ID NO: 2318 - DNA, 20 bp, Artificial Sequence
  Description of Artificial Sequence: Synthetic potential truncated RGN off-target sequence + PAM for VEGFA
gagtgagtgtgtgtgtgtgg

SEQ ID NO: 2319 - DNA, 20 bp, Artificial Sequence
  Description of Artificial Sequence: Synthetic potential truncated RGN off-target sequence + PAM for VEGFA
gagtgagtgtgtgcgcgggg

SEQ ID NO: 2320 - DNA, 20 bp, Artificial Sequence
  Description of Artificial Sequence: Synthetic potential truncated RGN off-target sequence + PAM for VEGFA
ctgtgagtgtgtgcgtgagg

SEQ ID NO: 2321 - DNA, 20 bp, Artificial Sequence
  Description of Artificial Sequence: Synthetic potential truncated RGN off-target sequence + PAM for VEGFA
atgtgagtgtgtgcgtgtgg

SEQ ID NO: 2322 - DNA, 20 bp, Artificial Sequence
  Description of Artificial Sequence: Synthetic potential truncated RGN off-target sequence + PAM for VEGFA
gcctgagtgtgtgcgtgtgg

SEQ ID NO: 2323 - DNA, 20 bp, Artificial Sequence
  Description of Artificial Sequence: Synthetic potential truncated RGN off-target sequence + PAM for VEGFA
gtgtgtgtgtgtgcgtgtgg

SEQ ID NO: 2324 - DNA, 20 bp, Artificial Sequence
  Description of Artificial Sequence: Synthetic potential truncated RGN off-target sequence + PAM for VEGFA
gtgtgggtgtgtgcgtgtgg

SEQ ID NO: 2325 - DNA, 20 bp, Artificial Sequence
  Description of Artificial Sequence: Synthetic potential truncated RGN off-target sequence + PAM for VEGFA
gcgtgtgtgtgtgcgtgtgg

SEQ ID NO: 2326 - DNA, 20 bp, Artificial Sequence
  Description of Artificial Sequence: Synthetic potential truncated RGN off-target sequence + PAM for VEGFA
gtgtgtgtgtgtgcgtgggg

SEQ ID NO: 2327 - DNA, 20 bp, Artificial Sequence
  Description of Artificial Sequence: Synthetic potential truncated RGN off-target sequence + PAM for VEGFA
gtgtgcgtgtgtgcgtgtgg

SEQ ID NO: 2328 - DNA, 20 bp, Artificial Sequence
  Description of Artificial Sequence: Synthetic potential truncated RGN off-target sequence + PAM for VEGFA
gtgtgtgtgtgtgcgtgcgg

SEQ ID NO: 2329 - DNA, 20 bp, Artificial Sequence
  Description of Artificial Sequence: Synthetic potential truncated RGN off-target sequence + PAM for VEGFA
gagagagagtgtgcgtgtgg

SEQ ID NO: 2330 - DNA, 20 bp, Artificial Sequence
  Description of Artificial Sequence: Synthetic potential truncated RGN off-target sequence + PAM for VEGFA
gagtgtgtgagtgcgtgggg

SEQ ID NO: 2331 - DNA, 20 bp, Artificial Sequence
  Description of Artificial Sequence: Synthetic potential truncated RGN off-target sequence + PAM for VEGFA
gtgtgagtgtgtgtgtgtgg

SEQ ID NO: 2332 - DNA, 20 bp, Artificial Sequence
  Description of Artificial Sequence: Synthetic potential truncated RGN off-target sequence + PAM for VEGFA
gagtgtgtgtatgcgtgtgg

SEQ ID NO: 2333 - DNA, 20 bp, Artificial Sequence
  Description of Artificial Sequence: Synthetic potential truncated RGN off-target sequence + PAM for VEGFA
gagtcagtgtgtgagtgagg

SEQ ID NO: 2334 - DNA, 20 bp, Artificial Sequence
  Description of Artificial Sequence: Synthetic potential truncated RGN off-target sequence + PAM for VEGFA
gagtgtgtgtgtgagtgtgg

SEQ ID NO: 2335 - DNA, 20 bp, Artificial Sequence
  Description of Artificial Sequence: Synthetic potential truncated RGN off-target sequence + PAM for VEGFA
gagtgtgtgtgtgcatgtgg

SEQ ID NO: 2336 - DNA, 20 bp, Artificial Sequence
  Description of Artificial Sequence: Synthetic potential truncated RGN off-target sequence + PAM for VEGFA
gagtgagagtgtgtgtgtgg

SEQ ID NO: 2337 - DNA, 20 bp, Artificial Sequence
  Description of Artificial Sequence: Synthetic potential truncated RGN off-target sequence + PAM for VEGFA
gagtgagtgagtgagtgagg

SEQ ID NO: 2338 - DNA, 21 bp, Artificial Sequence
  Description of Artificial Sequence: Synthetic truncated RGN on-target sequence + PAM for EMX1
gtccgagcagaagaagaaggg

SEQ ID NO: 2339 - DNA, 21 bp, Artificial Sequence
  Description of Artificial Sequence: Synthetic potential truncated RGN off-target sequence + PAM for EMX1
gtctgagcagaagaagaatgg

SEQ ID NO: 2340 - DNA, 21 bp, Artificial Sequence
  Description of Artificial Sequence: Synthetic potential truncated RGN off-target sequence + PAM for EMX1
gtcccagcagtagaagaatgg

SEQ ID NO: 2341 - DNA, 21 bp, Artificial Sequence
  Description of Artificial Sequence: Synthetic potential truncated RGN off-target sequence + PAM for EMX1
gtccgaggagaggaagaaagg

SEQ ID NO: 2342 - DNA, 21 bp, Artificial Sequence
  Description of Artificial Sequence: Synthetic potential truncated RGN off-target sequence + PAM for EMX1
gtcagaggagaagaagaaggg

SEQ ID NO: 2343 - DNA, 21 bp, Artificial Sequence
  Description of Artificial Sequence: Synthetic potential truncated RGN off-target sequence + PAM for EMX1
gacagagcagaagaagaaggg

SEQ ID NO: 2344 - DNA, 21 bp, Artificial Sequence
  Description of Artificial Sequence: Synthetic potential truncated RGN off-target sequence + PAM for EMX1
gtgggagcagaagaagaaggg

SEQ ID NO: 2345 - DNA, 21 bp, Artificial Sequence
  Description of Artificial Sequence: Synthetic potential truncated RGN off-target sequence + PAM for EMX1
gtactagcagaagaagaaagg

SEQ ID NO: 2346 - DNA, 21 bp, Artificial Sequence
  Description of Artificial Sequence: Synthetic potential truncated RGN off-target sequence + PAM for EMX1
gtctgagcacaagaagaatgg

SEQ ID NO: 2347 - DNA, 21 bp, Artificial Sequence
  Description of Artificial Sequence: Synthetic potential truncated RGN off-target sequence + PAM for EMX1
gtgctagcagaagaagaaggg

SEQ ID NO: 2348 - DNA, 21 bp, Artificial Sequence
  Description of Artificial Sequence: Synthetic potential truncated RGN off-target sequence + PAM for EMX1
tacagagcagaagaagaatgg

SEQ ID NO: 2349 - DNA, 21 bp, Artificial Sequence
  Description of Artificial Sequence: Synthetic potential truncated RGN off-target sequence + PAM for EMX1
tacggagcagaagaagaatgg

SEQ ID NO: 2350 - DNA, 21 bp, Artificial Sequence
  Description of Artificial Sequence: Synthetic potential truncated RGN off-target sequence + PAM for EMX1
aacggagcagaagaagaaagg

SEQ ID NO: 2351 - DNA, 21 bp, Artificial Sequence
  Description of Artificial Sequence: Synthetic potential truncated RGN off-target sequence + PAM for EMX1
gacacagcagaagaagaaggg

SEQ ID NO: 2352 - DNA, 21 bp, Artificial Sequence
  Description of Artificial Sequence: Synthetic potential truncated RGN off-target sequence + PAM for EMX1
ctgcgatcagaagaagaaagg

SEQ ID NO: 2353 - DNA, 21 bp, Artificial Sequence
  Description of Artificial Sequence: Synthetic potential truncated RGN off-target sequence + PAM for EMX1
gactgggcagaagaagaaggg

SEQ ID NO: 2354 - DNA, 21 bp, Artificial Sequence
  Description of Artificial Sequence: Synthetic potential truncated RGN off-target sequence + PAM for EMX1
ttccctgcagaagaagaaagg

SEQ ID NO: 2355 - DNA, 21 bp, Artificial Sequence
  Description of Artificial Sequence: Synthetic potential truncated RGN off-target sequence + PAM for EMX1
ttcctaccagaagaagaatgg

SEQ ID NO: 2356 - DNA, 21 bp, Artificial Sequence
  Description of Artificial Sequence: Synthetic potential truncated RGN off-target sequence + PAM for EMX1
ctctgaggagaagaagaaagg

SEQ ID NO: 2357 - DNA, 21 bp, Artificial Sequence
  Description of Artificial Sequence: Synthetic potential truncated RGN off-target sequence + PAM for EMX1
atccaatcagaagaagaaggg

SEQ ID NO: 2358 - DNA, 21 bp, Artificial Sequence
  Description of Artificial Sequence: Synthetic potential truncated RGN off-target sequence + PAM for EMX1
gcccctgcagaagaagaacgg

SEQ ID NO: 2359 - DNA, 21 bp, Artificial Sequence
  Description of Artificial Sequence: Synthetic potential truncated RGN off-target sequence + PAM for EMX1
atccaaccagaagaagaaagg

SEQ ID NO: 2360 - DNA, 21 bp, Artificial Sequence
  Description of Artificial Sequence: Synthetic potential truncated RGN off-target sequence + PAM for EMX1
gactgagaagaagaagaaagg

SEQ ID NO: 2361 - DNA, 21 bp, Artificial Sequence
  Description of Artificial Sequence: Synthetic potential truncated RGN off-target sequence + PAM for EMX1
gtgggatcagaagaagaaagg

SEQ ID NO: 2362 - DNA, 21 bp, Artificial Sequence
  Description of Artificial Sequence: Synthetic potential truncated RGN off-target sequence + PAM for EMX1
gacagagaagaagaagaaagg

SEQ ID NO: 2363 - DNA, 21 bp, Artificial Sequence
  Description of Artificial Sequence: Synthetic potential truncated RGN off-target sequence + PAM for EMX1
gtcatggcagaagaagaaagg

SEQ ID NO: 2364 - DNA, 21 bp, Artificial Sequence
  Description of Artificial Sequence: Synthetic potential truncated RGN off-target sequence + PAM for EMX1
gttggagaagaagaagaaggg

SEQ ID NO: 2365 - DNA, 21 bp, Artificial Sequence
  Description of Artificial Sequence: Synthetic potential truncated RGN off-target sequence + PAM for EMX1
gtaagagaagaagaagaaggg

SEQ ID NO: 2366 - DNA, 21 bp, Artificial Sequence
  Description of Artificial Sequence: Synthetic potential truncated RGN off-target sequence + PAM for EMX1
ctcctagcaaaagaagaatgg

SEQ ID NO: 2367 - DNA, 21 bp, Artificial Sequence
  Description of Artificial Sequence: Synthetic potential truncated RGN off-target sequence + PAM for EMX1
ttcagagcaggagaagaatgg

SEQ ID NO: 2368 - DNA, 21 bp, Artificial Sequence
  Description of Artificial Sequence: Synthetic potential truncated RGN off-target sequence + PAM for EMX1
gttggagcaggagaagaaggg

SEQ ID NO: 2369 - DNA, 21 bp, Artificial Sequence
  Description of Artificial Sequence: Synthetic potential truncated RGN off-target sequence + PAM for EMX1
gcctgagcagaaggagaaggg

SEQ ID NO: 2370 - DNA, 21 bp, Artificial Sequence
  Description of Artificial Sequence: Synthetic potential truncated RGN off-target sequence + PAM for EMX1
gtctgaggacaagaagaatgg

SEQ ID NO: 2371 - DNA, 21 bp, Artificial Sequence
  Description of Artificial Sequence: Synthetic potential truncated RGN off-target sequence + PAM for EMX1
gtccgggaaggagaagaaagg

SEQ ID NO: 2372 - DNA, 21 bp, Artificial Sequence
  Description of Artificial Sequence: Synthetic potential truncated RGN off-target sequence + PAM for EMX1
ggccgagcagaagaaagacgg

SEQ ID NO: 2373 - DNA, 21 bp, Artificial Sequence
  Description of Artificial Sequence: Synthetic potential truncated RGN off-target sequence + PAM for EMX1
gtcctagcaggagaagaagag

SEQ ID NO: 2374 - DNA, 21 bp, Artificial Sequence
  Description of Artificial Sequence: Synthetic potential truncated RGN off-target sequence for VEGFA
gtggggggagtttgccccagg

SEQ ID NO: 2375 - DNA, 21 bp, Artificial Sequence
  Description of Artificial Sequence: Synthetic potential truncated RGN off-target sequence for VEGFA
gtggggggtgtttgctcccgg

SEQ ID NO: 2376 - DNA, 21 bp, Artificial Sequence
  Description of Artificial Sequence: Synthetic potential truncated RGN off-target sequence for VEGFA
gtgggtggagtttgctactgg

SEQ ID NO: 2377 - DNA, 21 bp, Artificial Sequence
  Description of Artificial Sequence: Synthetic potential truncated RGN off-target sequence for VEGFA
gtgggtggagtttgctacagg

SEQ ID NO: 2378 - DNA, 21 bp, Artificial Sequence
  Description of Artificial Sequence: Synthetic potential truncated RGN off-target sequence for VEGFA
gtgggtggcgtttgctccagg

SEQ ID NO: 2379 - DNA, 21 bp, Artificial Sequence
  Description of Artificial Sequence: Synthetic potential truncated RGN off-target sequence for VEGFA
gtgtggggaatttgctccagg

SEQ ID NO: 2380 - DNA, 21 bp, Artificial Sequence
  Description of Artificial Sequence: Synthetic potential truncated RGN off-target sequence for VEGFA
gtggggggagctttctcctgg

SEQ ID NO: 2381 - DNA, 21 bp, Artificial Sequence
  Description of Artificial Sequence: Synthetic potential truncated RGN off-target sequence for VEGFA
gggggggcagtttgctcctgg

SEQ ID NO: 2382 - DNA, 20 bp, Artificial Sequence
  Description of Artificial Sequence: Synthetic potential truncated RGN off-target sequence for VEGFA
gtgtgagtgtgtgcgtgtgg

SEQ ID NO: 2383 - DNA, 20 bp, Artificial Sequence
  Description of Artificial Sequence: Synthetic potential truncated RGN off-target sequence for VEGFA
gtgtgagtgtgtgcgtgagg

SEQ ID NO: 2384 - DNA, 20 bp, Artificial Sequence
  Description of Artificial Sequence: Synthetic potential truncated RGN off-target sequence for VEGFA
gagtgggtgtgtgcgtgggg

SEQ ID NO: 2385 - DNA, 20 bp, Artificial Sequence
  Description of Artificial Sequence: Synthetic potential truncated RGN off-target sequence for VEGFA
gagtgactgtgtgcgtgtgg

SEQ ID NO: 2386 - DNA, 20 bp, Artificial Sequence
  Description of Artificial Sequence: Synthetic potential truncated RGN off-target sequence for VEGFA
gagtgagtgtgtgggtgggg

SEQ ID NO: 2387 - DNA, 20 bp, Artificial Sequence
  Description of Artificial Sequence: Synthetic potential truncated RGN off-target sequence for VEGFA
gtgtgagtgtgtgcgtgggg

SEQ ID NO: 2388 - DNA, 20 bp, Artificial Sequence
  Description of Artificial Sequence: Synthetic potential truncated RGN off-target sequence for VEGFA
cagtgagtgtgtgcgtgtgg

SEQ ID NO: 2389 - DNA, 20 bp, Artificial Sequence
  Description of Artificial Sequence: Synthetic potential truncated RGN off-target sequence for VEGFA
gtgtgagtgtgtgcgtgtgg

SEQ ID NO: 2390 - DNA, 20 bp, Artificial Sequence
  Description of Artificial Sequence: Synthetic potential truncated RGN off-target sequence for VEGFA
gagtgtgtgtgtgcgtgtgg

SEQ ID NO: 2391 - DNA, 20 bp, Artificial Sequence
  Description of Artificial Sequence: Synthetic potential truncated RGN off-target sequence for VEGFA
gagtgagtgtgtgtgtgtgg

SEQ ID NO: 2392 - DNA, 20 bp, Artificial Sequence
  Description of Artificial Sequence: Synthetic potential truncated RGN off-target sequence for VEGFA
gagtgagtgtgtgtgtgtgg

SEQ ID NO: 2393 - DNA, 20 bp, Artificial Sequence
  Description of Artificial Sequence: Synthetic potential truncated RGN off-target sequence for VEGFA
gagtgagtgtgtgtgtgggg

SEQ ID NO: 2394 - DNA, 20 bp, Artificial Sequence
  Description of Artificial Sequence: Synthetic potential truncated RGN off-target sequence for VEGFA
gagtgagtgtgtgtgtgtgg

SEQ ID NO: 2395 - DNA, 20 bp, Artificial Sequence
  Description of Artificial Sequence: Synthetic potential truncated RGN off-target sequence for VEGFA
gagtgagtgtgtgcgcgggg

SEQ ID NO: 2396 - DNA, 21 bp, Artificial Sequence
  Description of Artificial Sequence: Synthetic potential truncated RGN off-target sequence for EMX1
gtcagaggagaagaagaaggg

SEQ ID NO: 2397 - DNA, 21 bp, Artificial Sequence
  Description of Artificial Sequence: Synthetic potential truncated RGN off-target sequence for EMX1
gtcagaggagaagaagaaggg

SEQ ID NO: 2398 - DNA, 21 bp, Artificial Sequence
  Description of Artificial Sequence: Synthetic potential truncated RGN off-target sequence for EMX1
gtctgagcacaagaagaatgg

SEQ ID NO: 2399 - DNA, 21 bp, Artificial Sequence
  Description of Artificial Sequence: Synthetic potential truncated RGN off-target sequence for EMX1
gtctgagcagaagaagaatgg

SEQ ID NO: 2400 - DNA, 21 bp, Artificial Sequence
  Description of Artificial Sequence: Synthetic potential truncated RGN off-target sequence for EMX1
gacagagcagaagaagaaggg

SEQ ID NO: 2401 - DNA, 21 bp, Artificial Sequence
  Description of Artificial Sequence: Synthetic potential truncated RGN off-target sequence for EMX1
gtactagcagaagaagaaagg

SEQ ID NO: 2402 - DNA, 21 bp, Artificial Sequence
  Description of Artificial Sequence: Synthetic potential truncated RGN off-target sequence for EMX1
gtgggagcagaagaagaaggg

SEQ ID NO: 2403 - DNA, 21 bp, Artificial Sequence
  Description of Artificial Sequence: Synthetic potential truncated RGN off-target sequence for EMX1
gtcccagcagtagaagaatgg

SEQ ID NO: 2404 - RNA, 31 nt, Artificial Sequence
  Description of Artificial Sequence: Synthetic guide RNA sequence
  modified_base (1)..(19): a, c, u, g, unknown or other and this region may encompass 17-18 or 17-19 nucleotides
nnnnnnnnnnnnnnnnnnnguuuuagagcua

SEQ ID NO: 2405 - RNA, 60 nt, Artificial Sequence
  Description of Artificial Sequence: Synthetic tracrRNA sequence
uagcaaguuaaaauaaggcuaguccguuaucaacuugaaaaaguggcaccgagucggugc

SEQ ID NO: 2406 - RNA, 64 nt, Artificial Sequence
  Description of Artificial Sequence: Synthetic tracrRNA sequence
agcauagcaaguuaaaauaaggcuaguccguuaucaacuugaaaaaguggcaccgagucggugc

SEQ ID NO: 2407 - RNA, 41 nt, Artificial Sequence
  Description of Artificial Sequence: Synthetic guide RNA sequence
  modified_base (1)..(19): a, c, u, g, unknown or other and this region may encompass 17-18 or 17-19 nucleotides
nnnnnnnnnnnnnnnnnnnguuuuagagcuaugcuguuuug

SEQ ID NO: 2408 - RNA, 35 nt, Artificial Sequence
  Description of Artificial Sequence: Synthetic guide RNA sequence
  modified_base (1)..(19): a, c, u, g, unknown or other and this region may encompass 17-18 or 17-19 nucleotides
nnnnnnnnnnnnnnnnnnnguuuuagagcuaugcu

SEQ ID NO: 2409 - RNA, 70 nt, Artificial Sequence
  Description of Artificial Sequence: Synthetic tracrRNA sequence
caaaacagcauagcaaguuaaaauaaggcuaguccguuaucaacuugaaaaaguggcaccgagucggugc

SEQ ID NO: 2410 - RNA, 45 nt, Artificial Sequence
  Description of Artificial Sequence: Synthetic tracrRNA sequence
uagcaaguuaaaauaaggcuaguccguuaucaacuugaaaaagug

SEQ ID NO: 2411 - RNA, 32 nt, Artificial Sequence
  Description of Artificial Sequence: Synthetic tracrRNA sequence
uagcaaguuaaaauaaggcuaguccguuauca

SEQ ID NO: 2412 - RNA, 26 nt, Artificial Sequence
  Description of Artificial Sequence: Synthetic tracrRNA sequence
uagcaaguuaaaauaaggcuaguccg

SEQ ID NO: 2413 - DNA, 20 bp, Artificial Sequence
  Description of Artificial Sequence: Synthetic EGFP target site sequence
gggcacgggcagcttgccgg

SEQ ID NO: 2414 - DNA, 20 bp, Artificial Sequence
  Description of Artificial Sequence: Synthetic EGFP target site sequence
gggcacgggcagcttgccgc

SEQ ID NO: 2415 - DNA, 20 bp, Artificial Sequence
  Description of Artificial Sequence: Synthetic EGFP target site sequence
gggcacgggcagcttgcccg

SEQ ID NO: 2416 - DNA, 20 bp, Artificial Sequence
  Description of Artificial Sequence: Synthetic EGFP target site sequence
gggcacgggcagcttgcggg

SEQ ID NO: 2417 - DNA, 20 bp, Artificial Sequence
  Description of Artificial Sequence: Synthetic EGFP target site sequence
gggcacgggcagcttggcgg

SEQ ID NO: 2418 - DNA, 20 bp, Artificial Sequence
  Description of Artificial Sequence: Synthetic EGFP target site sequence
gggcacgggcagcttcccgg

SEQ ID NO: 2419 - DNA, 20 bp, Artificial Sequence
  Description of Artificial Sequence: Synthetic EGFP target site sequence
gggcacgggcagctagccgg

SEQ ID NO: 2420 - DNA, 20 bp, Artificial Sequence
  Description of Artificial Sequence: Synthetic EGFP target site sequence
gggcacgggcagcatgccgg

SEQ ID NO: 2421 - DNA, 20 bp, Artificial Sequence
  Description of Artificial Sequence: Synthetic EGFP target site sequence
gggcacgggcaggttgccgg

SEQ ID NO: 2422 - DNA, 20 bp, Artificial Sequence
  Description of Artificial Sequence: Synthetic EGFP target site sequence
gggcacgggcaccttgccgg

SEQ ID NO: 2423 - DNA, 20 bp, Artificial Sequence
  Description of Artificial Sequence: Synthetic EGFP target site sequence
gggcacgggctgcttgccgg

SEQ ID NO: 2424 - DNA, 20 bp, Artificial Sequence
  Description of Artificial Sequence: Synthetic EGFP target site sequence
gggcacggggagcttgccgg

SEQ ID NO: 2425 - DNA, 20 bp, Artificial Sequence
  Description of Artificial Sequence: Synthetic EGFP target site sequence
gggcacggccagcttgccgg

SEQ ID NO: 2426 - DNA, 20 bp, Artificial Sequence
  Description of Artificial Sequence: Synthetic EGFP target site sequence
gggcacgcgcagcttgccgg

SEQ ID NO: 2427 - DNA, 20 bp, Artificial Sequence
  Description of Artificial Sequence: Synthetic EGFP target site sequence
gggcaccggcagcttgccgg

SEQ ID NO: 2428 - DNA, 20 bp, Artificial Sequence
  Description of Artificial Sequence: Synthetic EGFP target site sequence
gggcaggggcagcttgccgg

SEQ ID NO: 2429 - DNA, 20 bp, Artificial Sequence
  Description of Artificial Sequence: Synthetic EGFP target site sequence
gggctcgggcagcttgccgg

SEQ ID NO: 2430 - DNA, 20 bp, Artificial Sequence
  Description of Artificial Sequence: Synthetic EGFP target site sequence
ggggacgggcagcttgccgg

SEQ ID NO: 2431 - DNA, 20 bp, Artificial Sequence
  Description of Artificial Sequence: Synthetic EGFP target site sequence
ggccacgggcagcttgccgg

SEQ ID NO: 2432 - DNA, 20 bp, Artificial Sequence
  Description of Artificial Sequence: Synthetic EGFP target site sequence
gcgcacgggcagcttgccgg

SEQ ID NO: 2433 - DNA, 20 bp, Artificial Sequence
  Description of Artificial Sequence: Synthetic EGFP target site sequence
gggcacgggcagcttgcccc

SEQ ID NO: 2434 - DNA, 20 bp, Artificial Sequence
  Description of Artificial Sequence: Synthetic EGFP target site sequence
gggcacgggcagcttggggg

SEQ ID NO: 2435 - DNA, 20 bp, Artificial Sequence
  Description of Artificial Sequence: Synthetic EGFP target site sequence
gggcacgggcagctacccgg

SEQ ID NO: 2436 - DNA, 20 bp, Artificial Sequence
  Description of Artificial Sequence: Synthetic EGFP target site sequence
gggcacgggcaggatgccgg

SEQ ID NO: 2437 - DNA, 20 bp, Artificial Sequence
  Description of Artificial Sequence: Synthetic EGFP target site sequence
gggcacgggctccttgccgg

SEQ ID NO: 2438 - DNA, 20 bp, Artificial Sequence
  Description of Artificial Sequence: Synthetic EGFP target site sequence
gggcacggcgagcttgccgg

SEQ ID NO: 2439 - DNA, 20 bp, Artificial Sequence
  Description of Artificial Sequence: Synthetic EGFP target site sequence
gggcacccgcagcttgccgg

SEQ ID NO: 2440 - DNA, 20 bp, Artificial Sequence
  Description of Artificial Sequence: Synthetic EGFP target site sequence
gggctggggcagcttgccgg

SEQ ID NO: 2441 - DNA, 20 bp, Artificial Sequence
  Description of Artificial Sequence: Synthetic EGFP target site sequence
ggcgacgggcagcttgccgg

SEQ ID NO: 2442 - DNA, 20 bp, Artificial Sequence
  Description of Artificial Sequence: Synthetic EGFP target site sequence
gcccacgggcagcttgccgg

SEQ ID NO: 2443 - DNA, 20 bp, Artificial Sequence
  Description of Artificial Sequence: Synthetic EGFP target site sequence
gccgacgggcagcttgccgg

SEQ ID NO: 2444 - DNA, 20 bp, Artificial Sequence
  Description of Artificial Sequence: Synthetic EGFP target site sequence
gccgtcgggcagcttgccgg

SEQ ID NO: 2445 - DNA, 20 bp, Artificial Sequence
  Description of Artificial Sequence: Synthetic EGFP target site sequence
gccgtggggcagcttgccgg

SEQ ID NO: 2446 - DNA, 20 bp, Artificial Sequence
  Description of Artificial Sequence: Synthetic EGFP target site sequence
gccgtgcggcagcttgccgg

SEQ ID NO: 2447 - DNA, 20 bp, Artificial Sequence
  Description of Artificial Sequence: Synthetic EGFP target site sequence
gccgtgccgcagcttgccgg

SEQ ID NO: 2448 - DNA, 20 bp, Artificial Sequence
  Description of Artificial Sequence: Synthetic EGFP target site sequence
gccgtgccccagcttgccgg

SEQ ID NO: 2449 - DNA, 20 bp, Artificial Sequence
  Description of Artificial Sequence: Synthetic EGFP target site sequence
gccgtgcccgagcttgccgg

SEQ ID NO: 2450 - DNA, 20 bp, Artificial Sequence
  Description of Artificial Sequence: Synthetic EGFP target site sequence
gggcacgggcagcttgcggc

SEQ ID NO: 2451 - DNA, 20 bp, Artificial Sequence
  Description of Artificial Sequence: Synthetic EGFP target site sequence
gggcacgggcagcttccggg

SEQ ID NO: 2452 - DNA, 20 bp, Artificial Sequence
  Description of Artificial Sequence: Synthetic EGFP target site sequence
gggcacgggcagcatgcggg

SEQ ID NO: 2453 - DNA, 20 bp, Artificial Sequence
  Description of Artificial Sequence: Synthetic EGFP target site sequence
gggcacgggcaccttgcggg

SEQ ID NO: 2454 - DNA, 20 bp, Artificial Sequence
  Description of Artificial Sequence: Synthetic EGFP target site sequence
gggcacggggagcttgcggg

SEQ ID NO: 2455 - DNA, 20 bp, Artificial Sequence
  Description of Artificial Sequence: Synthetic EGFP target site sequence
gggcacgcgcagcttgcggg

SEQ ID NO: 2456 - DNA, 20 bp, Artificial Sequence
  Description of Artificial Sequence: Synthetic EGFP target site sequence
gggcaggggcagcttgcggg

SEQ ID NO: 2457 - DNA, 20 bp, Artificial Sequence
  Description of Artificial Sequence: Synthetic EGFP target site sequence
ggggacgggcagcttgcggg

SEQ ID NO: 2458 - DNA, 20 bp, Artificial Sequence
  Description of Artificial Sequence: Synthetic EGFP target site sequence
gcgcacgggcagcttgcggg

SEQ ID NO: 2459 - DNA, 20 bp, Artificial Sequence
  Description of Artificial Sequence: Synthetic EGFP target site sequence
gggcacggggagcttgccgc

SEQ ID NO: 2460 - DNA, 20 bp, Artificial Sequence
  Description of Artificial Sequence: Synthetic EGFP target site sequence
gggcacggggagcttcccgg

SEQ ID NO: 2461 - DNA, 20 bp, Artificial Sequence
  Description of Artificial Sequence: Synthetic EGFP target site sequence
gggcacggggagcatgccgg

SEQ ID NO: 2462 - DNA, 20 bp, Artificial Sequence
  Description of Artificial Sequence: Synthetic EGFP target site sequence
gggcacggggaccttgccgg

SEQ ID NO: 2463 - DNA, 20 bp, Artificial Sequence
  Description of Artificial Sequence: Synthetic EGFP target site sequence
gggcacgcggagcttgccgg

SEQ ID NO: 2464 - DNA, 20 bp, Artificial Sequence
  Description of Artificial Sequence: Synthetic EGFP target site sequence
gggcagggggagcttgccgg

SEQ ID NO: 2465 - DNA, 20 bp, Artificial Sequence
  Description of Artificial Sequence: Synthetic EGFP target site sequence
ggggacggggagcttgccgg

SEQ ID NO: 2466 - DNA, 20 bp, Artificial Sequence
  Description of Artificial Sequence: Synthetic EGFP target site sequence
gcgcacggggagcttgccgg

SEQ ID NO: 2467 - DNA, 20 bp, Artificial Sequence
  Description of Artificial Sequence: Synthetic EGFP target site sequence
gcgcacgggcagcttgccgc

SEQ ID NO: 2468 - DNA, 20 bp, Artificial Sequence
  Description of Artificial Sequence: Synthetic EGFP target site sequence
gcgcacgggcagcttcccgg

SEQ ID NO: 2469 - DNA, 20 bp, Artificial Sequence
  Description of Artificial Sequence: Synthetic EGFP target site sequence
gcgcacgggcagcatgccgg

SEQ ID NO: 2470 - DNA, 20 bp, Artificial Sequence
  Description of Artificial Sequence: Synthetic EGFP target site sequence
gcgcacgggcaccttgccgg

SEQ ID NO: 2471 - DNA, 20 bp, Artificial Sequence
  Description of Artificial Sequence: Synthetic EGFP target site sequence
gcgcacgcgcagcttgccgg

SEQ ID NO: 2472 - DNA, 20 bp, Artificial Sequence
  Description of Artificial Sequence: Synthetic EGFP target site sequence
gcgcaggggcagcttgccgg

SEQ ID NO: 2473 - DNA, 20 bp, Artificial Sequence
  Description of Artificial Sequence: Synthetic EGFP target site sequence
gcggacgggcagcttgccgg

SEQ ID NO: 2474 - DNA, 20 bp, Artificial Sequence
  Description of Artificial Sequence: Synthetic EGFP target site sequence
gatgccgttcttctgcttgt

SEQ ID NO: 2475 - DNA, 20 bp, Artificial Sequence
  Description of Artificial Sequence: Synthetic EGFP target site sequence
gatgccgttcttctgcttga

SEQ ID NO: 2476 - DNA, 20 bp, Artificial Sequence
  Description of Artificial Sequence: Synthetic EGFP target site sequence
gatgccgttcttctgcttct

SEQ ID NO: 2477 - DNA, 20 bp, Artificial Sequence
  Description of Artificial Sequence: Synthetic EGFP target site sequence
gatgccgttcttctgctagt

SEQ ID NO: 2478 - DNA, 20 bp, Artificial Sequence
  Description of Artificial Sequence: Synthetic EGFP target site sequence
gatgccgttcttctgcatgt

SEQ ID NO: 2479 - DNA, 20 bp, Artificial Sequence
  Description of Artificial Sequence: Synthetic EGFP target site sequence
gatgccgttcttctggttgt

SEQ ID NO: 2480 - DNA, 20 bp, Artificial Sequence
  Description of Artificial Sequence: Synthetic EGFP target site sequence
gatgccgttcttctccttgt

SEQ ID NO: 2481 - DNA, 20 bp, Artificial Sequence
  Description of Artificial Sequence: Synthetic EGFP target site sequence
gatgccgttcttcagcttgt

SEQ ID NO: 2482 - DNA, 20 bp, Artificial Sequence
  Description of Artificial Sequence: Synthetic EGFP target site sequence
gatgccgttcttgtgcttgt

SEQ ID NO: 2483 - DNA, 20 bp, Artificial Sequence
  Description of Artificial Sequence: Synthetic EGFP target site sequence
gatgccgttctactgcttgt

SEQ ID NO: 2484 - DNA, 20 bp, Artificial Sequence
  Description of Artificial Sequence: Synthetic EGFP target site sequence
gatgccgttcatctgcttgt

SEQ ID NO: 2485 - DNA, 20 bp, Artificial Sequence
  Description of Artificial Sequence: Synthetic EGFP target site sequence
gatgccgttgttctgcttgt

SEQ ID NO: 2486 - DNA, 20 bp, Artificial Sequence
  Description of Artificial Sequence: Synthetic EGFP target site sequence
gatgccgtacttctgcttgt

SEQ ID NO: 2487 - DNA, 20 bp, Artificial Sequence
  Description of Artificial Sequence: Synthetic EGFP target site sequence
gatgccgatcttctgcttgt

SEQ ID NO: 2488 - DNA, 20 bp, Artificial Sequence
  Description of Artificial Sequence: Synthetic EGFP target site sequence
gatgcccttcttctgcttgt

SEQ ID NO: 2489 - DNA, 20 bp, Artificial Sequence
  Description of Artificial Sequence: Synthetic EGFP target site sequence
gatgcggttcttctgcttgt

SEQ ID NO: 2490 - DNA, 20 bp, Artificial Sequence
  Description of Artificial Sequence: Synthetic EGFP target site sequence
gatggcgttcttctgcttgt

SEQ ID NO: 2491 - DNA, 20 bp, Artificial Sequence
  Description of Artificial Sequence: Synthetic EGFP target site sequence
gatcccgttcttctgcttgt

SEQ ID NO: 2492 - DNA, 20 bp, Artificial Sequence
  Description of Artificial Sequence: Synthetic EGFP target site sequence
gatgccgttcttctgcttgt

SEQ ID NO: 2493 - DNA, 20 bp, Artificial Sequence
  Description of Artificial Sequence: Synthetic EGFP target site sequence
gatgccgttcttctgcttgt

SEQ ID NO: 2494 - DNA, 20 bp, Artificial Sequence
  Description of Artificial Sequence: Synthetic EGFP target site sequence
gatgccgttcttctgcttca

SEQ ID NO: 2495 - DNA, 20 bp, Artificial Sequence
  Description of Artificial Sequence: Synthetic EGFP target site sequence
gatgccgttcttctgcaagt

SEQ ID NO: 2496 - DNA, 20 bp, Artificial Sequence
  Description of Artificial Sequence: Synthetic EGFP target site sequence
gatgccgttcttctcgttgt

SEQ ID NO: 2497 - DNA, 20 bp, Artificial Sequence
  Description of Artificial Sequence: Synthetic EGFP target site sequence
gatgccgttcttgagcttgt

SEQ ID NO: 2498 - DNA, 20 bp, Artificial Sequence
  Description of Artificial Sequence: Synthetic EGFP target site sequence
gatgccgttcaactgcttgt

SEQ ID NO: 2499 - DNA, 20 bp, Artificial Sequence
  Description of Artificial Sequence: Synthetic EGFP target site sequence
gatgccgtagttctgcttgt

SEQ ID NO: 2500 - DNA, 20 bp, Artificial Sequence
  Description of Artificial Sequence: Synthetic EGFP target site sequence
gatgcccatcttctgcttgt

SEQ ID NO: 2501 - DNA, 20 bp, Artificial Sequence
  Description of Artificial Sequence: Synthetic EGFP target site sequence
gatggggttcttctgcttgt

SEQ ID NO: 2502 - DNA, 20 bp, Artificial Sequence
  Description of Artificial Sequence: Synthetic EGFP target site sequence
gaacccgttcttctgcttgt

SEQ ID NO: 2503 - DNA, 20 bp, Artificial Sequence
  Description of Artificial Sequence: Synthetic EGFP target site sequence
gtagccgttcttctgcttgt

SEQ ID NO: 2504 - DNA, 20 bp, Artificial Sequence
  Description of Artificial Sequence: Synthetic EGFP target site sequence
gtacccgttcttctgcttgt

SEQ ID NO: 2505 - DNA, 20 bp, Artificial Sequence
  Description of Artificial Sequence: Synthetic EGFP target site sequence
gtacgcgttcttctgcttgt

SEQ ID NO: 2506 - DNA, 20 bp, Artificial Sequence
  Description of Artificial Sequence: Synthetic EGFP target site sequence
gtacgggttcttctgcttgt

SEQ ID NO: 2507 - DNA, 20 bp, Artificial Sequence
  Description of Artificial Sequence: Synthetic EGFP target site sequence
gtacggcttcttctgcttgt

SEQ ID NO: 2508 - DNA, 20 bp, Artificial Sequence
  Description of Artificial Sequence: Synthetic EGFP target site sequence
gtacggcatcttctgcttgt

SEQ ID NO: 2509 - DNA, 20 bp, Artificial Sequence
  Description of Artificial Sequence: Synthetic EGFP target site sequence
gtacggcaacttctgcttgt

SEQ ID NO: 2510 - DNA, 20 bp, Artificial Sequence
  Description of Artificial Sequence: Synthetic EGFP target site sequence
gtacggcaagttctgcttgt

SEQ ID NO: 2511 - DNA, 20 bp, Artificial Sequence
  Description of Artificial Sequence: Synthetic EGFP target site sequence
gatgccgttcttctgctaga

SEQ ID NO: 2512 - DNA, 20 bp, Artificial Sequence
  Description of Artificial Sequence: Synthetic EGFP target site sequence
gatgccgttcttctggtagt

SEQ ID NO: 2513 - DNA, 20 bp, Artificial Sequence
  Description of Artificial Sequence: Synthetic EGFP target site sequence
gatgccgttcttcagctagt

SEQ ID NO: 2514 - DNA, 20 bp, Artificial Sequence
  Description of Artificial Sequence: Synthetic EGFP target site sequence
gatgccgttctactgctagt

SEQ ID NO: 2515 - DNA, 20 bp, Artificial Sequence
  Description of Artificial Sequence: Synthetic EGFP target site sequence
gatgccgttgttctgctagt

SEQ ID NO: 2516 - DNA, 20 bp, Artificial Sequence
  Description of Artificial Sequence: Synthetic EGFP target site sequence
gatgccgatcttctgctagt

SEQ ID NO: 2517 - DNA, 20 bp, Artificial Sequence
  Description of Artificial Sequence: Synthetic EGFP target site sequence
gatgcggttcttctgctagt

SEQ ID NO: 2518 - DNA, 20 bp, Artificial Sequence
  Description of Artificial Sequence: Synthetic EGFP target site sequence
gatcccgttcttctgctagt

SEQ ID NO: 2519 - DNA, 20 bp, Artificial Sequence
  Description of Artificial Sequence: Synthetic EGFP target site sequence
gttgccgttcttctgctagt

SEQ ID NO: 2520 - DNA, 20 bp, Artificial Sequence
  Description of Artificial Sequence: Synthetic EGFP target site sequence
gatgccgttgttctgcttga

SEQ ID NO: 2521 - DNA, 20 bp, Artificial Sequence
  Description of Artificial Sequence: Synthetic EGFP target site sequence
gatgccgttgttctggttgt

SEQ ID NO: 2522 - DNA, 20 bp, Artificial Sequence
  Description of Artificial Sequence: Synthetic EGFP target site sequence
gatgccgttgttcagcttgt

SEQ ID NO: 2523 - DNA, 20 bp, Artificial Sequence
  Description of Artificial Sequence: Synthetic EGFP target site sequence
gatgccgttgtactgcttgt

SEQ ID NO: 2524 - DNA, 20 bp, Artificial Sequence
  Description of Artificial Sequence: Synthetic EGFP target site sequence
gatgccgatgttctgcttgt

SEQ ID NO: 2525 - DNA, 20 bp, Artificial Sequence
  Description of Artificial Sequence: Synthetic EGFP target site sequence
gatgcggttgttctgcttgt

SEQ ID NO: 2526 - DNA, 20 bp, Artificial Sequence
  Description of Artificial Sequence: Synthetic EGFP target site sequence
gatcccgttgttctgcttgt

SEQ ID NO: 2527 - DNA, 20 bp, Artificial Sequence
  Description of Artificial Sequence: Synthetic EGFP target site sequence
gttgccgttgttctgcttgt

SEQ ID NO: 2528 - DNA, 20 bp, Artificial Sequence
  Description of Artificial Sequence: Synthetic EGFP target site sequence
gttgccgttcttctgcttga

SEQ ID NO: 2529 - DNA, 20 bp, Artificial Sequence
  Description of Artificial Sequence: Synthetic EGFP target site sequence
gttgccgttcttctggttgt

SEQ ID NO: 2530 - DNA, 20 bp, Artificial Sequence
  Description of Artificial Sequence: Synthetic EGFP target site sequence
gttgccgttcttcagcttgt

SEQ ID NO: 2531 - DNA, 20 bp, Artificial Sequence
  Description of Artificial Sequence: Synthetic EGFP target site sequence
gttgccgttctactgcttgt

SEQ ID NO: 2532 - DNA, 20 bp, Artificial Sequence
  Description of Artificial Sequence: Synthetic EGFP target site sequence
gttgccgatcttctgcttgt

SEQ ID NO: 2533 - DNA, 20 bp, Artificial Sequence
  Description of Artificial Sequence: Synthetic EGFP target site sequence
gttgcggttcttctgcttgt

SEQ ID NO: 2534 - DNA, 20 bp, Artificial Sequence
  Description of Artificial Sequence: Synthetic EGFP target site sequence
gttcccgttcttctgcttgt

SEQ ID NO: 2535 - DNA, 20 bp, Artificial Sequence
  Description of Artificial Sequence: Synthetic EGFP target site sequence
ggtggtgcagatgaacttca

SEQ ID NO: 2536 - DNA, 20 bp, Artificial Sequence
  Description of Artificial Sequence: Synthetic EGFP target site sequence
ggtggtgcagatgaacttct

SEQ ID NO: 2537 - DNA, 20 bp, Artificial Sequence
  Description of Artificial Sequence: Synthetic EGFP target site sequence
ggtggtgcagatgaacttga

SEQ ID NO: 2538 - DNA, 20 bp, Artificial Sequence
  Description of Artificial Sequence: Synthetic EGFP target site sequence
ggtggtgcagatgaactaca

SEQ ID NO: 2539 - DNA, 20 bp, Artificial Sequence
  Description of Artificial Sequence: Synthetic EGFP target site sequence
ggtggtgcagatgaacatca

SEQ ID NO: 2540 - DNA, 20 bp, Artificial Sequence
  Description of Artificial Sequence: Synthetic EGFP target site sequence
ggtggtgcagatgaagttca

SEQ ID NO: 2541 - DNA, 20 bp, Artificial Sequence
  Description of Artificial Sequence: Synthetic EGFP target site sequence
ggtggtgcagatgatcttca

SEQ ID NO: 2542 - DNA, 20 bp, Artificial Sequence
  Description of Artificial Sequence: Synthetic EGFP target site sequence
ggtggtgcagatgtacttca

SEQ ID NO: 2543 - DNA, 20 bp, Artificial Sequence
  Description of Artificial Sequence: Synthetic EGFP target site sequence
ggtggtgcagatcaacttca

SEQ ID NO: 2544 - DNA, 20 bp, Artificial Sequence
  Description of Artificial Sequence: Synthetic EGFP target site sequence
ggtggtgcagaagaacttca

SEQ ID NO: 2545 - DNA, 20 bp, Artificial Sequence
  Description of Artificial Sequence: Synthetic EGFP target site sequence
ggtggtgcagttgaacttca

SEQ ID NO: 2546 - DNA, 20 bp, Artificial Sequence
  Description of Artificial Sequence: Synthetic EGFP target site sequence
ggtggtgcacatgaacttca

SEQ ID NO: 2547 - DNA, 20 bp, Artificial Sequence
  Description of Artificial Sequence: Synthetic EGFP target site sequence
ggtggtgctgatgaacttca

SEQ ID NO: 2548 - DNA, 20 bp, Artificial Sequence
  Description of Artificial Sequence: Synthetic EGFP target site sequence
ggtggtggagatgaacttca

SEQ ID NO: 2549 - DNA, 20 bp, Artificial Sequence
  Description of Artificial Sequence: Synthetic EGFP target site sequence
ggtggtccagatgaacttca

SEQ ID NO: 2550 - DNA, 20 bp, Artificial Sequence
  Description of Artificial Sequence: Synthetic EGFP target site sequence
ggtggagcagatgaacttca

SEQ ID NO: 2551 - DNA, 20 bp, Artificial Sequence
  Description of Artificial Sequence: Synthetic EGFP target site sequence
ggtgctgcagatgaacttca

SEQ ID NO: 2552 - DNA, 20 bp, Artificial Sequence
  Description of Artificial Sequence: Synthetic EGFP target site sequence
ggtcgtgcagatgaacttca

SEQ ID NO: 2553 - DNA, 20 bp, Artificial Sequence
  Description of Artificial Sequence: Synthetic EGFP target site sequence
ggaggtgcagatgaacttca

SEQ ID NO: 2554 - DNA, 20 bp, Artificial Sequence
  Description of Artificial Sequence: Synthetic EGFP target site sequence
gctggtgcagatgaacttca

SEQ ID NO: 2555 - DNA, 20 bp, Artificial Sequence
  Description of Artificial Sequence: Synthetic EGFP target site sequence
ggtggtgcagatgaacttgt

SEQ ID NO: 2556 - DNA, 20 bp, Artificial Sequence
  Description of Artificial Sequence: Synthetic EGFP target site sequence
ggtggtgcagatgaacaaca

SEQ ID NO: 2557 - DNA, 20 bp, Artificial Sequence
  Description of Artificial Sequence: Synthetic EGFP target site sequence
ggtggtgcagatgatgttca

SEQ ID NO: 2558 - DNA, 20 bp, Artificial Sequence
  Description of Artificial Sequence: Synthetic EGFP target site sequence
ggtggtgcagatctacttca

SEQ ID NO: 2559 - DNA, 20 bp, Artificial Sequence
  Description of Artificial Sequence: Synthetic EGFP target site sequence
ggtggtgcagtagaacttca

SEQ ID NO: 2560 - DNA, 20 bp, Artificial Sequence
  Description of Artificial Sequence: Synthetic EGFP target site sequence
ggtggtgctcatgaacttca

SEQ ID NO: 2561 - DNA, 20 bp, Artificial Sequence
  Description of Artificial Sequence: Synthetic EGFP target site sequence
ggtggtcgagatgaacttca

SEQ ID NO: 2562 - DNA, 20 bp, Artificial Sequence
  Description of Artificial Sequence: Synthetic EGFP target site sequence
ggtgcagcagatgaacttca

SEQ ID NO: 2563 - DNA, 20 bp, Artificial Sequence
  Description of Artificial Sequence: Synthetic EGFP target site sequence
ggacgtgcagatgaacttca

SEQ ID NO: 2564 - DNA, 20 bp, Artificial Sequence
  Description of Artificial Sequence: Synthetic EGFP target site sequence
gcaggtgcagatgaacttca

SEQ ID NO: 2565 - DNA, 20 bp, Artificial Sequence
  Description of Artificial Sequence: Synthetic EGFP target site sequence
gcacgtgcagatgaacttca

SEQ ID NO: 2566 - DNA, 20 bp, Artificial Sequence
  Description of Artificial Sequence: Synthetic EGFP target site sequence
gcacctgcagatgaacttca

SEQ ID NO: 2567 - DNA, 20 bp, Artificial Sequence
  Description of Artificial Sequence: Synthetic EGFP target site sequence
gcaccagcagatgaacttca

SEQ ID NO: 2568 - DNA, 20 bp, Artificial Sequence
  Description of Artificial Sequence: Synthetic EGFP target site sequence
gcaccaccagatgaacttca

SEQ ID NO: 2569 - DNA, 20 bp, Artificial Sequence
  Description of Artificial Sequence: Synthetic EGFP target site sequence
gcaccacgagatgaacttca

SEQ ID NO: 2570 - DNA, 20 bp, Artificial Sequence
  Description of Artificial Sequence: Synthetic EGFP target site sequence
gcaccacgtgatgaacttca

SEQ ID NO: 2571 - DNA, 20 bp, Artificial Sequence
  Description of Artificial Sequence: Synthetic EGFP target site sequence
gcaccacgtcatgaacttca

SEQ ID NO: 2572 - DNA, 20 bp, Artificial Sequence
  Description of Artificial Sequence: Synthetic EGFP target site sequence
ggtggtgcagatgaactact

SEQ ID NO: 2573 - DNA, 20 bp, Artificial Sequence
  Description of Artificial Sequence: Synthetic EGFP target site sequence
ggtggtgcagatgaagtaca

SEQ ID NO: 2574 - DNA, 20 bp, Artificial Sequence
  Description of Artificial Sequence: Synthetic EGFP target site sequence
ggtggtgcagatgtactaca

SEQ ID NO: 2575 - DNA, 20 bp, Artificial Sequence
  Description of Artificial Sequence: Synthetic EGFP target site sequence
ggtggtgcagaagaactaca

SEQ ID NO: 2576 - DNA, 20 bp, Artificial Sequence
  Description of Artificial Sequence: Synthetic EGFP target site sequence
ggtggtgcacatgaactaca

SEQ ID NO: 2577 - DNA, 20 bp, Artificial Sequence
  Description of Artificial Sequence: Synthetic EGFP target site sequence
ggtggtggagatgaactaca

SEQ ID NO: 2578 - DNA, 20 bp, Artificial Sequence
  Description of Artificial Sequence: Synthetic EGFP target site sequence
ggtggagcagatgaactaca

SEQ ID NO: 2579 - DNA, 20 bp, Artificial Sequence
  Description of Artificial Sequence: Synthetic EGFP target site sequence
ggtcgtgcagatgaactaca

SEQ ID NO: 2580 - DNA, 20 bp, Artificial Sequence
  Description of Artificial Sequence: Synthetic EGFP target site sequence
gctggtgcagatgaactaca

SEQ ID NO: 2581 - DNA, 20 bp, Artificial Sequence
  Description of Artificial Sequence: Synthetic EGFP target site sequence
ggtggtgcacatgaacttct

SEQ ID NO: 2582 - DNA, 20 bp, Artificial Sequence
  Description of Artificial Sequence: Synthetic EGFP target site sequence
ggtggtgcacatgaagttca

SEQ ID NO: 2583 - DNA, 20 bp, Artificial Sequence
  Description of Artificial Sequence: Synthetic EGFP target site sequence
ggtggtgcacatgtacttca

SEQ ID NO: 2584 - DNA, 20 bp, Artificial Sequence
  Description of Artificial Sequence: Synthetic EGFP target site sequence
ggtggtgcacaagaacttca

SEQ ID NO: 2585 - DNA, 20 bp, Artificial Sequence
  Description of Artificial Sequence: Synthetic EGFP target site sequence
ggtggtggacatgaacttca

SEQ ID NO: 2586 - DNA, 20 bp, Artificial Sequence
  Description of Artificial Sequence: Synthetic EGFP target site sequence
ggtggagcacatgaacttca

SEQ ID NO: 2587 - DNA, 20 bp, Artificial Sequence
  Description of Artificial Sequence: Synthetic EGFP target site sequence
ggtcgtgcacatgaacttca

SEQ ID NO: 2588 - DNA, 20 bp, Artificial Sequence
  Description of Artificial Sequence: Synthetic EGFP target site sequence
gctggtgcacatgaacttca

SEQ ID NO: 2589 - DNA, 20 bp, Artificial Sequence
  Description of Artificial Sequence: Synthetic EGFP target site sequence
gctggtgcagatgaacttct

SEQ ID NO: 2590 - DNA, 20 bp, Artificial Sequence
  Description of Artificial Sequence: Synthetic EGFP target site sequence
gctggtgcagatgaagttca

SEQ ID NO: 2591 - DNA, 20 bp, Artificial Sequence
  Description of Artificial Sequence: Synthetic EGFP target site sequence
gctggtgcagatgtacttca

SEQ ID NO: 2592 - DNA, 20 bp, Artificial Sequence
  Description of Artificial Sequence: Synthetic EGFP target site sequence
gctggtgcagaagaacttca

SEQ ID NO: 2593 - DNA, 20 bp, Artificial Sequence
  Description of Artificial Sequence: Synthetic EGFP target site sequence
gctggtggagatgaacttca

SEQ ID NO: 2594 - DNA, 20 bp, Artificial Sequence
  Description of Artificial Sequence: Synthetic EGFP target site sequence
gctggagcagatgaacttca

SEQ ID NO: 2595 - DNA, 20 bp, Artificial Sequence
  Description of Artificial Sequence: Synthetic EGFP target site sequence
gctcgtgcagatgaacttca

SEQ ID NO: 2596 - DNA, 20 bp, Artificial Sequence
  Description of Artificial Sequence: Synthetic VEGFA target site sequence
gggtggggggagtttgctcc

SEQ ID NO: 2597 - DNA, 20 bp, Artificial Sequence
  Description of Artificial Sequence: Synthetic VEGFA target site sequence
gaccccctccaccccgcctc

SEQ ID NO: 2598 - DNA, 20 bp, Artificial Sequence
  Description of Artificial Sequence: Synthetic VEGFA target site sequence
ggtgagtgagtgtgtgcgtg

SEQ ID NO: 2599 - DNA, 20 bp, Artificial Sequence
  Description of Artificial Sequence: Synthetic EMX1 target site sequence
gagtccgagcagaagaagaa

SEQ ID NO: 2600 - DNA, 20 bp, Artificial Sequence
  Description of Artificial Sequence: Synthetic RNF2 target site sequence
gtcatcttagtcattacctg

SEQ ID NO: 2601 - DNA, 20 bp, Artificial Sequence
  Description of Artificial Sequence: Synthetic FANCF target site sequence
ggaatcccttctgcagcacc

SEQ ID NO: 2602 - DNA, 18 bp, Artificial Sequence
  Description of Artificial Sequence: Synthetic EGFP target site sequence
gcacgggcagcttgccgg

SEQ ID NO: 2603 - DNA, 18 bp, Artificial Sequence
  Description of Artificial Sequence: Synthetic EGFP target site sequence
gcacgggcagcttgccgc

SEQ ID NO: 2604 - DNA, 18 bp, Artificial Sequence
  Description of Artificial Sequence: Synthetic EGFP target site sequence
gcacgggcagcttgcccg

SEQ ID NO: 2605 - DNA, 18 bp, Artificial Sequence
  Description of Artificial Sequence: Synthetic EGFP target site sequence
gcacgggcagcttgcggg

SEQ ID NO: 2606 - DNA, 18 bp, Artificial Sequence
  Description of Artificial Sequence: Synthetic EGFP target site sequence
gcacgggcagcttggcgg

SEQ ID NO: 2607 - DNA, 18 bp, Artificial Sequence
  Description of Artificial Sequence: Synthetic EGFP target site sequence
gcacgggcagcttcccgg

SEQ ID NO: 2608 - DNA, 18 bp, Artificial Sequence
  Description of Artificial Sequence: Synthetic EGFP target site sequence
gcacgggcagctagccgg

SEQ ID NO: 2609 - DNA, 18 bp, Artificial Sequence
  Description of Artificial Sequence: Synthetic EGFP target site sequence
gcacgggcagcatgccgg

SEQ ID NO: 2610 - DNA, 18 bp, Artificial Sequence
  Description of Artificial Sequence: Synthetic EGFP target site sequence
gcacgggcaggttgccgg

SEQ ID NO: 2611 - DNA, 18 bp, Artificial Sequence
  Description of Artificial Sequence: Synthetic EGFP target site sequence
gcacgggcaccttgccgg

SEQ ID NO: 2612 - DNA, 18 bp, Artificial Sequence
  Description of Artificial Sequence: Synthetic EGFP target site sequence
gcacgggctgcttgccgg

SEQ ID NO: 2613 - DNA, 18 bp, Artificial Sequence
  Description of Artificial Sequence: Synthetic EGFP target site sequence
gcacggggagcttgccgg

SEQ ID NO: 2614 - DNA, 18 bp, Artificial Sequence
  Description of Artificial Sequence: Synthetic EGFP target site sequence
gcacggccagcttgccgg

SEQ ID NO: 2615 - DNA, 18 bp, Artificial Sequence
  Description of Artificial Sequence: Synthetic EGFP target site sequence
gcacgcgcagcttgccgg

SEQ ID NO: 2616 - DNA, 18 bp, Artificial Sequence
  Description of Artificial Sequence: Synthetic EGFP target site sequence
gcaccggcagcttgccgg

SEQ ID NO: 2617 - DNA, 18 bp, Artificial Sequence
  Description of Artificial Sequence: Synthetic EGFP target site sequence
gcaggggcagcttgccgg

SEQ ID NO: 2618 - DNA, 18 bp, Artificial Sequence
  Description of Artificial Sequence: Synthetic EGFP target site sequence
gctcgggcagcttgccgg

SEQ ID NO: 2619 - DNA, 18 bp, Artificial Sequence
  Description of Artificial Sequence: Synthetic EGFP target site sequence
ggacgggcagcttgccgg

SEQ ID NO: 2620 - DNA, 18 bp, Artificial Sequence
  Description of Artificial Sequence: Synthetic EGFP target site sequence
gcacgggcagcttgcccc

SEQ ID NO: 2621 - DNA, 18 bp, Artificial Sequence
  Description of Artificial Sequence: Synthetic EGFP target site sequence
gcacgggcagcttggggg

SEQ ID NO: 2622 - DNA, 18 bp, Artificial Sequence
  Description of Artificial Sequence: Synthetic EGFP target site sequence
gcacgggcagctacccgg

SEQ ID NO: 2623 - DNA, 18 bp, Artificial Sequence
  Description of Artificial Sequence: Synthetic EGFP target site sequence
gcacgggcaggatgccgg

SEQ ID NO: 2624 - DNA, 18 bp, Artificial Sequence
  Description of Artificial Sequence: Synthetic EGFP target site sequence
gcacgggctccttgccgg

SEQ ID NO: 2625 - DNA, 18 bp, Artificial Sequence
  Description of Artificial Sequence: Synthetic EGFP target site sequence
gcacggcgagcttgccgg

SEQ ID NO: 2626 - DNA, 18 bp, Artificial Sequence
  Description of Artificial Sequence: Synthetic EGFP target site sequence
gcacccgcagcttgccgg

SEQ ID NO: 2627 - DNA, 18 bp, Artificial Sequence
  Description of Artificial Sequence: Synthetic EGFP target site sequence
gctggggcagcttgccgg

SEQ ID NO: 2628 - DNA, 18 bp, Artificial Sequence
  Description of Artificial Sequence: Synthetic EGFP target site sequence
ggtcgggcagcttgccgg

SEQ ID NO: 2629 - DNA, 17 bp, Artificial Sequence
  Description of Artificial Sequence: Synthetic EGFP target site sequence
gccgttcttctgcttgt

SEQ ID NO: 2630 - DNA, 17 bp, Artificial Sequence
  Description of Artificial Sequence: Synthetic EGFP target site sequence
gccgttcttctgcttga

SEQ ID NO: 2631 - DNA, 17 bp, Artificial Sequence
  Description of Artificial Sequence: Synthetic EGFP target site sequence
gccgttcttctgcttct

SEQ ID NO: 2632 - DNA, 17 bp, Artificial Sequence
  Description of Artificial Sequence: Synthetic EGFP target site sequence
gccgttcttctgctagt

SEQ ID NO: 2633 - DNA, 17 bp, Artificial Sequence
  Description of Artificial Sequence: Synthetic EGFP target site sequence
gccgttcttctgcatgt

SEQ ID NO: 2634 - DNA, 17 bp, Artificial Sequence
  Description of Artificial Sequence: Synthetic EGFP target site sequence
gccgttcttctggttgt

SEQ ID NO: 2635 - DNA, 17 bp, Artificial Sequence
  Description of Artificial Sequence: Synthetic EGFP target site sequence
gccgttcttctccttgt

SEQ ID NO: 2636 - DNA, 17 bp, Artificial Sequence
  Description of Artificial Sequence: Synthetic EGFP target site sequence
gccgttcttcagcttgt

SEQ ID NO: 2637 - DNA, 17 bp, Artificial Sequence
  Description of Artificial Sequence: Synthetic EGFP target site sequence
gccgttcttgtgcttgt

SEQ ID NO: 2638 - DNA, 17 bp, Artificial Sequence
  Description of Artificial Sequence: Synthetic EGFP target site sequence
gccgttctactgcttgt

SEQ ID NO: 2639 - DNA, 17 bp, Artificial Sequence
  Description of Artificial Sequence: Synthetic EGFP target site sequence
gccgttcatctgcttgt

SEQ ID NO: 2640 - DNA, 17 bp, Artificial Sequence
  Description of Artificial Sequence: Synthetic EGFP target site sequence
gccgttgttctgcttgt

SEQ ID NO: 2641 - DNA, 17 bp, Artificial Sequence
  Description of Artificial Sequence: Synthetic EGFP target site sequence
gccgtacttctgcttgt

SEQ ID NO: 2642 - DNA, 17 bp, Artificial Sequence
  Description of Artificial Sequence: Synthetic EGFP target site sequence
gccgatcttctgcttgt

SEQ ID NO: 2643 - DNA, 17 bp, Artificial Sequence
  Description of Artificial Sequence: Synthetic EGFP target site sequence
gcccttcttctgcttgt

SEQ ID NO: 2644 - DNA, 17 bp, Artificial Sequence
  Description of Artificial Sequence: Synthetic EGFP target site sequence
gcggttcttctgcttgt

SEQ ID NO: 2645 - DNA, 17 bp, Artificial Sequence
  Description of Artificial Sequence: Synthetic EGFP target site sequence
ggcgttcttctgcttgt

SEQ ID NO: 2646 - DNA, 17 bp, Artificial Sequence
  Description of Artificial Sequence: Synthetic EGFP target site sequence
gccgttcttctgcttca

SEQ ID NO: 2647 - DNA, 17 bp, Artificial Sequence
  Description of Artificial Sequence: Synthetic EGFP target site sequence
gccgttcttctgcaagt

SEQ ID NO: 2648 - DNA, 17 bp, Artificial Sequence
  Description of Artificial Sequence: Synthetic EGFP target site sequence
gccgttcttctcgttgt

SEQ ID NO: 2649 - DNA, 17 bp, Artificial Sequence
  Description of Artificial Sequence: Synthetic EGFP target site sequence
gccgttcttgagcttgt

SEQ ID NO: 2650 - DNA, 17 bp, Artificial Sequence
  Description of Artificial Sequence: Synthetic EGFP target site sequence
gccgttcaactgcttgt

SEQ ID NO: 2651 - DNA, 17 bp, Artificial Sequence
  Description of Artificial Sequence: Synthetic EGFP target site sequence
gccgtagttctgcttgt

SEQ ID NO: 2652 - DNA, 17 bp, Artificial Sequence
  Description of Artificial Sequence: Synthetic EGFP target site sequence
gcccatcttctgcttgt

SEQ ID NO: 2653 - DNA, 17 bp, Artificial Sequence
  Description of Artificial Sequence: Synthetic EGFP target site sequence
ggggttcttctgcttgt

SEQ ID NO: 2654 - DNA, 17 bp, Artificial Sequence
  Description of Artificial Sequence: Synthetic EGFP target site sequence
ggtgcagatgaacttca

SEQ ID NO: 2655 - DNA, 17 bp, Artificial Sequence
  Description of Artificial Sequence: Synthetic EGFP target site sequence
ggtgcagatgaacttct

SEQ ID NO: 2656 - DNA, 17 bp, Artificial Sequence
  Description of Artificial Sequence: Synthetic EGFP target site sequence
ggtgcagatgaacttga

SEQ ID NO: 2657 - DNA, 17 bp, Artificial Sequence
  Description of Artificial Sequence: Synthetic EGFP target site sequence
ggtgcagatgaactaca

SEQ ID NO: 2658 - DNA, 17 bp, Artificial Sequence
  Description of Artificial Sequence: Synthetic EGFP target site sequence
ggtgcagatgaacatca

SEQ ID NO: 2659 - DNA, 17 bp, Artificial Sequence
  Description of Artificial Sequence: Synthetic EGFP target site sequence
ggtgcagatgaagttca

SEQ ID NO: 2660 - DNA, 17 bp, Artificial Sequence
  Description of Artificial Sequence: Synthetic EGFP target site sequence
ggtgcagatgatcttca

SEQ ID NO: 2661 - DNA, 17 bp, Artificial Sequence
  Description of Artificial Sequence: Synthetic EGFP target site sequence
ggtgcagatgtacttca

SEQ ID NO: 2662 - DNA, 17 bp, Artificial Sequence
  Description of Artificial Sequence: Synthetic EGFP target site sequence
ggtgcagatcaacttca

SEQ ID NO: 2663 - DNA, 17 bp, Artificial Sequence
  Description of Artificial Sequence: Synthetic EGFP target site sequence
ggtgcagaagaacttca

SEQ ID NO: 2664 - DNA, 17 bp, Artificial Sequence
  Description of Artificial Sequence: Synthetic EGFP target site sequence
ggtgcagttgaacttca

SEQ ID NO: 2665 - DNA, 17 bp, Artificial Sequence
  Description of Artificial Sequence: Synthetic EGFP target site sequence
ggtgcacatgaacttca

SEQ ID NO: 2666 - DNA, 17 bp, Artificial Sequence
  Description of Artificial Sequence: Synthetic EGFP target site sequence
ggtgctgatgaacttca

SEQ ID NO: 2667 - DNA, 17 bp, Artificial Sequence
  Description of Artificial Sequence: Synthetic EGFP target site sequence
ggtggagatgaacttca

SEQ ID NO: 2668 - DNA, 17 bp, Artificial Sequence
  Description of Artificial Sequence: Synthetic EGFP target site sequence
ggtccagatgaacttca

SEQ ID NO: 2669 - DNA, 17 bp, Artificial Sequence
  Description of Artificial Sequence: Synthetic EGFP target site sequence
ggagcagatgaacttca

SEQ ID NO: 2670 - DNA, 17 bp, Artificial Sequence
  Description of Artificial Sequence: Synthetic EGFP target site sequence
gctgcagatgaacttca

SEQ ID NO: 2671 - DNA, 17 bp, Artificial Sequence
  Description of Artificial Sequence: Synthetic EGFP target site sequence
ggtgcagatgaacttgt

SEQ ID NO: 2672 - DNA, 17 bp, Artificial Sequence
  Description of Artificial Sequence: Synthetic EGFP target site sequence
ggtgcagatgaacaaca

SEQ ID NO: 2673 - DNA, 17 bp, Artificial Sequence
  Description of Artificial Sequence: Synthetic EGFP target site sequence
ggtgcagatgatgttca

SEQ ID NO: 2674 - DNA, 17 bp, Artificial Sequence
  Description of Artificial Sequence: Synthetic EGFP target site sequence
ggtgcagatctacttca

SEQ ID NO: 2675 - DNA, 17 bp, Artificial Sequence
  Description of Artificial Sequence: Synthetic EGFP target site sequence
ggtgcagtagaacttca

SEQ ID NO: 2676 - DNA, 17 bp, Artificial Sequence
  Description of Artificial Sequence: Synthetic EGFP target site sequence
ggtgctcatgaacttca

SEQ ID NO: 2677 - DNA, 17 bp, Artificial Sequence
  Description of Artificial Sequence: Synthetic EGFP target site sequence
ggtcgagatgaacttca

SEQ ID NO: 2678 - DNA, 17 bp, Artificial Sequence
  Description of Artificial Sequence: Synthetic EGFP target site sequence
gcagcagatgaacttca

SEQ ID NO: 2679 - DNA, 18 bp, Artificial Sequence
  Description of Artificial Sequence: Synthetic VEGFA Site 1 true-gRNA target sequence
gtggggggagtttgctcc

SEQ ID NO: 2680 - DNA, 17 bp, Artificial Sequence
  Description of Artificial Sequence: Synthetic VEGFA Site 3 true-gRNA target sequence
gagtgagtgtgtgcgtg

SEQ ID NO: 2681 - DNA, 18 bp, Artificial Sequence
  Description of Artificial Sequence: Synthetic EMX1 Site 1 true-gRNA target sequence
gtccgagcagaagaagaa

SEQ ID NO: 2682 - DNA, 20 bp, Artificial Sequence
  Description of Artificial Sequence: Synthetic CTLA full-length gRNA target sequence
gcagatgtagtgtttccaca

SEQ ID NO: 2683 - DNA, 17 bp, Artificial Sequence
  Description of Artificial Sequence: Synthetic CTLA tru-gRNA target sequence
gatgtagtgtttccaca

SEQ ID NO: 2684 - DNA, 20 bp, Artificial Sequence
  Description of Artificial Sequence: Synthetic VEGFA site 4 full length gRNA target sequence
tccctctttagccagagccg

SEQ ID NO: 2685 - DNA, 20 bp, Artificial Sequence
  Description of Artificial Sequence: Synthetic EMX1 site 2 full length gRNA target sequence
gccgtttgtactttgtcctc

SEQ ID NO: 2686 - DNA, 17 bp, Artificial Sequence
  Description of Artificial Sequence: Synthetic EMX1 site 2 tru-gRNA target sequence
gtttgtactttgtcctc

SEQ ID NO: 2687 - DNA, 20 bp, Artificial Sequence
  Description of Artificial Sequence: Synthetic EMX1 site 3 full-length gRNA target sequence
gggaagactgaggctacata

SEQ ID NO: 2688 - DNA, 18 bp, Artificial Sequence
  Description of Artificial Sequence: Synthetic EMX1 site 3 tru-gRNA target sequence
gaagactgaggctacata

SEQ ID NO: 2689 - DNA, 20 bp, Artificial Sequence
  Description of Artificial Sequence: Synthetic EMX1 site 4 full length gRNA target sequence
gaggcccccagagcagccac

SEQ ID NO: 2690 - DNA, 17 bp, Artificial Sequence
  Description of Artificial Sequence: Synthetic EMX1 site 4 tru-gRNA target sequence
gcccccagagcagccac

SEQ ID NO: 2691 - DNA, 23 bp, Artificial Sequence
  Description of Artificial Sequence: Synthetic EGFP target binding site
ggtgagtgagtgtgtgcgtgtgg

SEQ ID NO: 2692 - DNA, 23 bp, Artificial Sequence
  Description of Artificial Sequence: Synthetic EGFP target binding site
ccacacgcacacactcactcacc

SEQ ID NO: 2693 - RNA, 20 nt, Artificial Sequence
  Description of Artificial Sequence: Synthetic guide RNA
ggugagugagugugugcgug

SEQ ID NO: 2694 - DNA, 18 bp, Artificial Sequence
  Description of Artificial Sequence: Synthetic target binding site sequence
gggcgatgccacctacgg

SEQ ID NO: 2695 - DNA, 20 bp, Artificial Sequence
  Description of Artificial Sequence: Synthetic target binding site sequence
gagggcgatgccacctacgg

SEQ ID NO: 2696 - DNA, 22 bp, Artificial Sequence
  Description of Artificial Sequence: Synthetic target binding site sequence
gcgagggcgatgccacctacgg

SEQ ID NO: 2697 - DNA, 23 bp, Artificial Sequence
  Description of Artificial Sequence: Synthetic target binding site sequence
ggcgagggcgatgccacctacgg

SEQ ID NO: 2698 - DNA, 24 bp, Artificial Sequence
  Description of Artificial Sequence: Synthetic target binding site sequence
gggcgagggcgatgccacctacgg

SEQ ID NO: 2699 - DNA, 26 bp, Artificial Sequence
  Description of Artificial Sequence: Synthetic target binding site sequence
gagggcgagggcgatgccacctacgg

SEQ ID NO: 2700 - DNA, 28 bp, Artificial Sequence
  Description of Artificial Sequence: Synthetic target binding site sequence
gcgagggcgagggcgatgccacctacgg

SEQ ID NO: 2701 - DNA, 21 bp, Artificial Sequence
  Description of Artificial Sequence: Synthetic EGFP target binding site sequence
gcacgggcagcttgccggtgg

SEQ ID NO: 2702 - DNA, 20 bp, Artificial Sequence
  Description of Artificial Sequence: Synthetic EGFP target binding site sequence
gccgttcttctgcttgtcgg

SEQ ID NO: 2703 - DNA, 19 bp, Artificial Sequence
  Description of Artificial Sequence: Synthetic EGFP target binding site sequence
gtgcagatgaacttcaggg

SEQ ID NO: 2704 - DNA, 20 bp, Artificial Sequence
  Description of Artificial Sequence: Synthetic EGFP target binding site sequence
ggtgcagatgaacttcaggg

SEQ ID NO: 2705 - DNA, 19 bp, Artificial Sequence
  Description of Artificial Sequence: Synthetic EGFP target binding site sequence
gaggagctgttcaccgggg

SEQ ID NO: 2706 - DNA, 21 bp, Artificial Sequence
  Description of Artificial Sequence: Synthetic EGFP target binding site sequence
gcgaggagctgttcaccgggg

SEQ ID NO: 2707 - DNA, 23 bp, Artificial Sequence
  Description of Artificial Sequence: Synthetic EGFP target binding site sequence
gggcgaggagctgttcaccgggg

SEQ ID NO: 2708 - DNA, 21 bp, Artificial Sequence
  Description of Artificial Sequence: Synthetic VEGFA target binding site sequence
gtggggggagtttgctcctgg

SEQ ID NO: 2709 - DNA, 23 bp, Artificial Sequence
  Description of Artificial Sequence: Synthetic VEGFA target binding site sequence
gggtggggggagtttgctcctgg

SEQ ID NO: 2710 - DNA, 20 bp, Artificial Sequence
  Description of Artificial Sequence: Synthetic VEGFA target binding site sequence
gagtgagtgtgtgcgtgtgg

SEQ ID NO: 2711 - DNA, 23 bp, Artificial Sequence
  Description of Artificial Sequence: Synthetic VEGFA target binding site sequence
ggtgagtgagtgtgtgcgtgtgg

SEQ ID NO: 2712 - DNA, 21 bp, Artificial Sequence
  Description of Artificial Sequence: Synthetic EMX1 target binding site sequence
gtccgagcagaagaagaaggg

SEQ ID NO: 2713 - DNA, 23 bp, Artificial Sequence
  Description of Artificial Sequence: Synthetic EMX1 target binding site sequence
gagtccgagcagaagaagaaggg

SEQ ID NO: 2714 - DNA, 20 bp, Artificial Sequence
  Description of Artificial Sequence: Synthetic EMX1 target binding site sequence
gtttgtactttgtcctccgg

SEQ ID NO: 2715 - DNA, 23 bp, Artificial Sequence
  Description of Artificial Sequence: Synthetic EMX1 target binding site sequence
gccgtttgtactttgtcctccgg

SEQ ID NO: 2716 - DNA, 21 bp, Artificial Sequence
  Description of Artificial Sequence: Synthetic EMX1 target binding site sequence
gaagactgaggctacataggg

SEQ ID NO: 2717 - DNA, 23 bp, Artificial Sequence
  Description of Artificial Sequence: Synthetic EMX1 target binding site sequence
gggaagactgaggctacataggg

SEQ ID NO: 2718 - DNA, 20 bp, Artificial Sequence
  Description of Artificial Sequence: Synthetic EMX1 target binding site sequence
gcccccagagcagccactgg

SEQ ID NO: 2719 - DNA, 23 bp, Artificial Sequence
  Description of Artificial Sequence: Synthetic EMX1 target binding site sequence
gaggcccccagagcagccactgg

SEQ ID NO: 2720 - DNA, 20 bp, Artificial Sequence
  Description of Artificial Sequence: Synthetic CLTA target binding site sequence
gatgtagtgtttccacaggg

SEQ ID NO: 2721 - DNA, 23 bp, Artificial Sequence
  Description of Artificial Sequence: Synthetic CLTA target binding site sequence
gcagatgtagtgtttccacaggg

SEQ ID NO: 2722 - DNA, 67 bp, Artificial Sequence
  Description of Artificial Sequence: Synthetic target binding site sequence
gaagctggaggaggaagggcctgagtccgagcagaagaagaagggctcccatcacatcaaccggtgg

SEQ ID NO: 2723 - DNA, 15 bp, Artificial Sequence
  Description of Artificial Sequence: Synthetic target binding site sequence
gaagctggaggagga

SEQ ID NO: 2724 - DNA, 11 bp, Artificial Sequence
  Description of Artificial Sequence: Synthetic target binding site sequence
tcaaccggtgg

SEQ ID NO: 2725 - DNA, 18 bp, Artificial Sequence
  Description of Artificial Sequence: Synthetic target binding site sequence
gaagctggaggaggaagg

SEQ ID NO: 2726 - DNA, 25 bp, Artificial Sequence
  Description of Artificial Sequence: Synthetic target binding site sequence
gggctcccatcacatcaaccggtgg

SEQ ID NO: 2727 - DNA, 24 bp, Artificial Sequence
  Description of Artificial Sequence: Synthetic target binding site sequence
gaagctggaggaggaagggcctga

SEQ ID NO: 2728 - DNA, 14 bp, Artificial Sequence
  Description of Artificial Sequence: Synthetic target binding site sequence
gaagctggaggagg

SEQ ID NO: 2729 - DNA, 39 bp, Artificial Sequence
  Description of Artificial Sequence: Synthetic target binding site sequence
gaagctggaggaggaagggcccatcacatcaaccggtgg

SEQ ID NO: 2730 - DNA, 40 bp, Artificial Sequence
  Description of Artificial Sequence: Synthetic target binding site sequence
gaagctggaggaggaagggctcgcacacatcaaccggtgg

SEQ ID NO: 2731 - DNA, 42 bp, Artificial Sequence
  Description of Artificial Sequence: Synthetic target binding site sequence
gaagctggaggaggaagggccttccatcacatcaaccggtgg

SEQ ID NO: 2732 - DNA, 46 bp, Artificial Sequence
  Description of Artificial Sequence: Synthetic target binding site sequence
gaagctggaggaggaagggcctgagtcccatcacatcaaccggtgg

SEQ ID NO: 2733 - DNA, 52 bp, Artificial Sequence
  Description of Artificial Sequence: Synthetic target binding site sequence
gaagctggaggaggaagggcctgagtccgagtcccatcacatcaaccggtgg

SEQ ID NO: 2734 - DNA, 58 bp, Artificial Sequence
  Description of Artificial Sequence: Synthetic target binding site sequence
gaagctggaggaggaagggcctgagtccgagcagaagtcccatcacatcaaccggtgg

SEQ ID NO: 2735 - DNA, 59 bp, Artificial Sequence
  Description of Artificial Sequence: Synthetic target binding site sequence
gaagctggaggaggaagggcctgagtcctgccgtttgtagccatcacatcaaccggtgg

SEQ ID NO: 2736 - DNA, 61 bp, Artificial Sequence
  Description of Artificial Sequence: Synthetic target binding site sequence
gaagctggaggaggaagggcctgagtccgagcagaagagctcccatcacatcaaccggtgg

SEQ ID NO: 2737 - DNA, 61 bp, Artificial Sequence
  Description of Artificial Sequence: Synthetic target binding site sequence
gaagctggaggaggaagggcctgagtccgagcagaagaactcccatcacatcaaccggtgg

SEQ ID NO: 2738 - DNA, 64 bp, Artificial Sequence
  Description of Artificial Sequence: Synthetic target binding site sequence
gaagctggaggaggaagggcctgagtccgagcagaagaagggctcccatcacatcaaccggtgg

SEQ ID NO: 2739 - DNA, 65 bp, Artificial Sequence
  Description of Artificial Sequence: Synthetic target binding site sequence
gaagctggaggaggaagggcctgagtccgagcagaagaaagggctcccatcacatcaaccggtgg

SEQ ID NO: 2740 - DNA, 67 bp, Artificial Sequence
  Description of Artificial Sequence: Synthetic target binding site sequence
gaagctggaggaggaagggcctgagtccgagcagaagaacagaagggctcccatcacatcaaccggt

SEQ ID NO: 2741 - DNA, 67 bp, Artificial Sequence; identical to SEQ ID NO: 2722
  Description of Artificial Sequence: Synthetic target binding site sequence

SEQ ID NO: 2742 - DNA, 31 bp, Artificial Sequence
  Description of Artificial Sequence: Synthetic target binding site sequence
gaagctggaggaggaagggcctgagtccgag

SEQ ID NO: 2743 - DNA, 11 bp, Artificial Sequence
  Description of Artificial Sequence: Synthetic target binding site sequence
gaagctggagg

SEQ ID NO: 2744 - DNA, 11 bp, Artificial Sequence
  Description of Artificial Sequence: Synthetic target binding site sequence
gaagctggagg

SEQ ID NO: 2745 - DNA, 28 bp, Artificial Sequence
  Description of Artificial Sequence: Synthetic target binding site sequence
gaagctggaggaggaagggcctgagtgg

SEQ ID NO: 2746 - DNA, 41 bp, Artificial Sequence
  Description of Artificial Sequence: Synthetic target binding site sequence
gaagctggaggaggaagggctcccatcacatcaaccggtgg

SEQ ID NO: 2747 - DNA, 45 bp, Artificial Sequence
  Description of Artificial Sequence: Synthetic target binding site sequence
gaagctggaggaggaagggcctgagtccatcacatcaaccggtgg

SEQ ID NO: 2748 - DNA, 46 bp, Artificial Sequence; identical to SEQ ID NO: 2732
  Description of Artificial Sequence: Synthetic target binding site sequence

SEQ ID NO: 2749 - DNA, 49 bp, Artificial Sequence
  Description of Artificial Sequence: Synthetic target binding site sequence
gaagctggaggaggaagggcctgagtccgagcatcacatcaaccggtgg

SEQ ID NO: 2750 - DNA, 53 bp, Artificial Sequence
  Description of Artificial Sequence: Synthetic target binding site sequence
gaagctggaggaggaagggcctgagtccgagctcccatcacatcaaccggtgg

SEQ ID NO: 2751 - DNA, 61 bp, Artificial Sequence
  Description of Artificial Sequence: Synthetic target binding site sequence
gaagctggaggaggaagggcctgagtccgagcagaagggctcccatcacatcaaccggtgg

SEQ ID NO: 2752 - DNA, 64 bp, Artificial Sequence; identical to SEQ ID NO: 2738
  Description of Artificial Sequence: Synthetic target binding site sequence

SEQ ID NO: 2753 - DNA, 65 bp, Artificial Sequence
  Description of Artificial Sequence: Synthetic target binding site sequence
gaagctggaggaggaagggcctgagtccgagcagaaagaagggctcccatcacatcaaccggtgg

SEQ ID NO: 2754 - DNA, 67 bp, Artificial Sequence; identical to SEQ ID NO: 2740
  Description of Artificial Sequence: Synthetic target binding site sequence

SEQ ID NO: 2755 - DNA, 97 bp, Artificial Sequence
  Description of Artificial Sequence: Synthetic VEGFA target binding site sequence
aggtcagaaatagggggtccaggagcaaactccccccaccccctttccaaagcccattccctctttagccagagccggggtgtgcagacggcagtca

SEQ ID NO: 2756 - DNA, 97 bp, Artificial Sequence
  Description of Artificial Sequence: Synthetic VEGFA target binding site sequence
tgactgccgtctgcacaccccggctctggctaaagagggaatgggctttggaaagggggtggggggagtttgctcctggaccccctatttctgacct

SEQ ID NO: 2757 - DNA, 23 bp, Artificial Sequence
  Description of Artificial Sequence: Synthetic VEGFA target binding site sequence
gggtggggggagtttgctcctgg

SEQ ID NO: 2758 - DNA, 23 bp, Artificial Sequence
  Description of Artificial Sequence: Synthetic VEGFA target binding site sequence
tagtggagggagcttgctcctgg

SEQ ID NO: 2759 - DNA, 23 bp, Artificial Sequence
  Description of Artificial Sequence: Synthetic VEGFA target binding site sequence
tagtggagggagcttgctcctgg

SEQ ID NO: 2760 - DNA, 21 bp, Artificial Sequence
  Description of Artificial Sequence: Synthetic VEGFA target binding site sequence
gtggagggagcttgctcctgg

SEQ ID NO: 2761 - DNA, 67 bp, Artificial Sequence
  Description of Artificial Sequence: Synthetic VEGFA target binding site sequence
tagctgtttgggaggtcagaaatagggggtccaggagcaaactccccccaccccctttccaaagccc

SEQ ID NO: 2762 - DNA, 8 bp, Artificial Sequence
  Description of Artificial Sequence: Synthetic VEGFA target binding site sequence
tagctgtt

SEQ ID NO: 2763 - DNA, 14 bp, Artificial Sequence
  Description of Artificial Sequence: Synthetic VEGFA target binding site sequence
cctttccaaagccc

SEQ ID NO: 2764 - DNA, 9 bp, Artificial Sequence
  Description of Artificial Sequence: Synthetic VEGFA target binding site sequence
ccaaagccc

SEQ ID NO: 2765 - DNA, 22 bp, Artificial Sequence
  Description of Artificial Sequence: Synthetic VEGFA target binding site sequence
ccccaccccctttccaaagccc

SEQ ID NO: 2766 - DNA, 18 bp, Artificial Sequence
  Description of Artificial Sequence: Synthetic VEGFA target binding site sequence
tagctgtttccaaagccc

SEQ ID NO: 2767 - DNA, 18 bp, Artificial Sequence
  Description of Artificial Sequence: Synthetic VEGFA target binding site sequence
tagccctttccaaagccc

SEQ ID NO: 2768 - DNA, 20 bp, Artificial Sequence
  Description of Artificial Sequence: Synthetic VEGFA target binding site sequence
tagctgtttgggaggtcaga

SEQ ID NO: 2769 - DNA, 24 bp, Artificial Sequence
  Description of Artificial Sequence: Synthetic VEGFA target binding site sequence
tagctgttcccctttccaaagccc

SEQ ID NO: 2770 - DNA, 28 bp, Artificial Sequence
  Description of Artificial Sequence: Synthetic VEGFA target binding site sequence
tagctgtttgggaggtcagaaatagccc

SEQ ID NO: 2771 - DNA, 29 bp, Artificial Sequence
  Description of Artificial Sequence: Synthetic VEGFA target binding site sequence
tagctgtttgggtggcctttccaaagccc

SEQ ID NO: 2772 - DNA, 34 bp, Artificial Sequence
  Description of Artificial Sequence: Synthetic VEGFA target binding site sequence
tagctgtttgggaggtcagaaataggcaaagccc

SEQ ID NO: 2773 - DNA, 35 bp, Artificial Sequence
  Description of Artificial Sequence: Synthetic VEGFA target binding site sequence
tagctgtttgggaggtcaccccctttccaaagccc

SEQ ID NO: 2774 - DNA, 37 bp, Artificial Sequence
  Description of Artificial Sequence: Synthetic VEGFA target binding site sequence
  modified_base (31)..(31): a, c, t, g, unknown or other
tagctgtttctgacctcccaccccctttccnaagccc

SEQ ID NO: 2775 - DNA, 39 bp, Artificial Sequence
  Description of Artificial Sequence: Synthetic VEGFA target binding site sequence
  modified_base (36)..(36): a, c, t, g, unknown or other
tagctgtttgggaggtcagaaatagggggtccaganccc

SEQ ID NO: 2776 - DNA, 41 bp, Artificial Sequence
  Description of Artificial Sequence: Synthetic VEGFA target binding site sequence
tagctgtttgggaggtcagaaataccccctttccaaagccc

SEQ ID NO: 2777 - DNA, 45 bp, Artificial Sequence
  Description of Artificial Sequence: Synthetic VEGFA target binding site sequence
tagctgtttgggaggtcagaaatagggggtccctttccaaagccc

SEQ ID NO: 2778 - DNA, 48 bp, Artificial Sequence
  Description of Artificial Sequence: Synthetic VEGFA target binding site sequence
tagctgtttgggaggtcagaaactccccccaccccctttccaaagccc

SEQ ID NO: 2779 - DNA, 50 bp, Artificial Sequence
  Description of Artificial Sequence: Synthetic VEGFA target binding site sequence
tagctgtttgggaggtcagaaatagggggtccaccccctttccaaagccc

SEQ ID NO: 2780 - DNA, 51 bp, Artificial Sequence
  Description of Artificial Sequence: Synthetic VEGFA target binding site sequence
tagctgtttgggaggtcagaaatagggggtcccaccccctttccaaagccc

SEQ ID NO: 2781 - DNA, 52 bp, Artificial Sequence
  Description of Artificial Sequence: Synthetic VEGFA target binding site sequence
  modified_base (35)..(35): a, c, t, g, unknown or other
  modified_base (46)..(46): a, c, t, g, unknown or other
  modified_base (49)..(49): a, c, t, g, unknown or other
tagctgtttgggaggtcagaaatagggtccccccnccccctttccnaanccc

SEQ ID NO: 2782 - DNA, 52 bp, Artificial Sequence
  Description of Artificial Sequence: Synthetic VEGFA target binding site sequence
tagctgtttgggaggtcagaagcaaactccccccaccccctttccaaagccc

SEQ ID NO: 2783 - DNA, 52 bp, Artificial Sequence
  Description of Artificial Sequence: Synthetic VEGFA target binding site sequence
tagctgtttgggaggtcagaaataaactccccccaccccctttccaaagccc

SEQ ID NO: 2784 - DNA, 53 bp, Artificial Sequence
  Description of Artificial Sequence: Synthetic VEGFA target binding site sequence
  modified_base (1)..(1): a, c, t, g, unknown or other
  modified_base (7)..(7): a, c, t, g, unknown or other
  modified_base (16)..(16): a, c, t, g, unknown or other
  modified_base (18)..(19): a, c, t, g, unknown or other
  modified_base (21)..(22): a, c, t, g, unknown or other
  modified_base (50)..(50): a, c, t, g, unknown or other
nagctgnttgggaggncnnanngcaaactccccccaccccctttccaaanccc

SEQ ID NO: 2785 - DNA, 53 bp, Artificial Sequence
  Description of Artificial Sequence: Synthetic VEGFA target binding site sequence
tagctgtttgggaggtcagaaatagggggtcccccaccccctttccaaagccc

SEQ ID NO: 2786 - DNA, 54 bp, Artificial Sequence
  Description of Artificial Sequence: Synthetic VEGFA target binding site sequence
tagctgtttgggaggtcagaaatagggggtccacccaccccctttccaaagccc

SEQ ID NO: 2787 - DNA, 55 bp, Artificial Sequence
  Description of Artificial Sequence: Synthetic VEGFA target binding site sequence
tagctgtttgggaggtcagaaatagcaaactccccccaccccctttccaaagccc

SEQ ID NO: 2788 - DNA, 58 bp, Artificial Sequence
  Description of Artificial Sequence: Synthetic VEGFA target binding site sequence
tagctgtttgggaggtcagaaatagggggtccaggaccccaccccctttccaaagccc

SEQ ID NO: 2789 - DNA, 60 bp, Artificial Sequence
  Description of Artificial Sequence: Synthetic VEGFA target binding site sequence
tagctgtttgggaggtcagaaatagggggtccaactccccccaccccctttccaaagccc

SEQ ID NO: 2790 - DNA, 61 bp, Artificial Sequence
  Description of Artificial Sequence: Synthetic VEGFA target binding site sequence
tagctgtttgggaggtcagaaatagggggtccaccccctttccaccccctttccaaagccc

SEQ ID NO: 2791 - DNA, 62 bp, Artificial Sequence
  Description of Artificial Sequence: Synthetic VEGFA target binding site sequence
tagctgtttgggaggtcagaaatagggggtccaggactccccccaccccctttccaaagccc

SEQ ID NO: 2792 - DNA, 63 bp, Artificial Sequence
  Description of Artificial Sequence: Synthetic VEGFA target binding site sequence
tagctgtttgggaggtcagaaatagggggtccaggaactccccccaccccctttccaaagccc

SEQ ID NO: 2793 - DNA, 64 bp, Artificial Sequence
  Description of Artificial Sequence: Synthetic VEGFA target binding site sequence
tagctgtttgggaggtcagaaatagggggtccagcaaactccccccaccccctttccaaagccc

SEQ ID NO: 2794 - DNA, 65 bp, Artificial Sequence
  Description of Artificial Sequence: Synthetic VEGFA target binding site sequence
tagctgtttgggaggtcagaaatagggggtccaggcaaactccccccaccccctttccaaagccc

SEQ ID NO: 2795 - DNA, 258 bp, Artificial Sequence
  Description of Artificial Sequence: Synthetic VEGFA target binding site sequence
  modified_base (197)..(197): a, c, t, g, unknown or other
tagctgtttgggaggtcagaaatagggggtccaggagtgctagatcttcatctaaagacatttctgagaaaaatgtatctgttttctttcagaagaaatttacacttaatagatattatggtaactaaagtaaggcagataattttggccatcagcttatattgtgggataatctctttttgctgaccttgaaaagntgtggcatattcacaacaagtaggaaaattgcaaactccccccaccccctttccaaagccc

SEQ ID NO: 2796 - DNA, 67 bp, Artificial Sequence
  Description of Artificial Sequence: Synthetic VEGFA target binding site sequence
tgggaggtcagaaatagggggtccaggagcaaactccccccaccccctttccaaagcccattccctc

SEQ ID NO: 2797 - DNA, 28 bp, Artificial Sequence
  Description of Artificial Sequence: Synthetic VEGFA target binding site sequence
tgggaggtcagaaatagggggtccagga

SEQ ID NO: 2798 - DNA, 27 bp, Artificial Sequence
  Description of Artificial Sequence: Synthetic VEGFA target binding site sequence
caccctctttccaaagcccattccctc

SEQ ID NO: 2799 - DNA, 38 bp, Artificial Sequence
  Description of Artificial Sequence: Synthetic VEGFA target binding site sequence
caaactccccccaccccctttccaaagcccattccctc

SEQ ID NO: 2800 - DNA, 14 bp, Artificial Sequence
  Description of Artificial Sequence: Synthetic VEGFA target binding site sequence
aagcccattccctc

SEQ ID NO: 2801 - DNA, 6 bp, Artificial Sequence
  Description of Artificial Sequence: Synthetic VEGFA target binding site sequence
tccctc

SEQ ID NO: 2802 - DNA, 19 bp, Artificial Sequence
  Description of Artificial Sequence: Synthetic VEGFA target binding site sequence
ttccaaagcccattccctc

SEQ ID NO: 2803 - DNA, 9 bp, Artificial Sequence
  Description of Artificial Sequence: Synthetic VEGFA target binding site sequence
tgggaggtc

SEQ ID NO: 2804 - DNA, 29 bp, Artificial Sequence
  Description of Artificial Sequence: Synthetic VEGFA target binding site sequence
cccaccccctttccaaagcccattccctc

SEQ ID NO: 2805 - DNA, 29 bp, Artificial Sequence
  Description of Artificial Sequence: Synthetic VEGFA target binding site sequence
cccaccccctttccaaagcccattccctc

SEQ ID NO: 2806 - DNA, 28 bp, Artificial Sequence
  Description of Artificial Sequence: Synthetic VEGFA target binding site sequence
tgggcccctttccaaagcccattccctc

SEQ ID NO: 2807 - DNA, 31 bp, Artificial Sequence
  Description of Artificial Sequence: Synthetic VEGFA target binding site sequence
tgggagccccctttccaaagcccattccctc

SEQ ID NO: 2808 - DNA, 41 bp, Artificial Sequence
  Description of Artificial Sequence: Synthetic VEGFA target binding site sequence
tgggaggtcagaaacaccccctttccaaagcccattccctc

SEQ ID NO: 2809 - DNA, 47 bp, Artificial Sequence
  Description of Artificial Sequence: Synthetic VEGFA target binding site sequence
tgggaggtcagaaatagggggtccccctttccaaagcccattccctc

SEQ ID NO: 2810 - DNA, 50 bp, Artificial Sequence
  Description of Artificial Sequence: Synthetic VEGFA target binding site sequence
  modified_base (36)..(36): a, c, t, g, unknown or other
tgggaggtcagaaaaactccccccaccccctttccnaagcccattccctc

SEQ ID NO: 2811 - DNA, 50 bp, Artificial Sequence
  Description of Artificial Sequence: Synthetic VEGFA target binding site sequence
tgggaggtcagaaatagggggtccaccccctttccaaagcccattccctc

SEQ ID NO: 2812 - DNA, 51 bp, Artificial Sequence
  Description of Artificial Sequence: Synthetic VEGFA target binding site sequence
tgggaggtcagaaatagggggtcccaccccctttccaaagcccattccctc

SEQ ID NO: 2813 - DNA, 51 bp, Artificial Sequence
  Description of Artificial Sequence: Synthetic VEGFA target binding site sequence
tgggaggtcagaaataggtccccccaccccctttccaaagcccattccctc

SEQ ID NO: 2814 - DNA, 52 bp, Artificial Sequence
  Description of Artificial Sequence: Synthetic VEGFA target binding site sequence
  modified_base (3)..(3): a, c, t, g, unknown or other
tgngaggtcagaagcaaactccccccaccccctttccaaagcccattccctc

SEQ ID NO: 2815 - DNA, 52 bp, Artificial Sequence
  Description of Artificial Sequence: Synthetic VEGFA target binding site sequence
tgggaggtcagaaatagggggtccccaccccctttccaaagcccattccctc

SEQ ID NO: 2816 - DNA, 54 bp, Artificial Sequence
  Description of Artificial Sequence: Synthetic VEGFA target binding site sequence
tgggaggtcagaaatagggggtccccccaccccctttccaaagcccattccctc

SEQ ID NO: 2817 - DNA, 55 bp, Artificial Sequence
  Description of Artificial Sequence: Synthetic VEGFA target binding site sequence
tgggaggtcagaaatagggggtccaggacaccccctttccaaagcccattccctc

SEQ ID NO: 2818 - DNA, 56 bp, Artificial Sequence
  Description of Artificial Sequence: Synthetic VEGFA target binding site sequence
tgggaggtcagaaataggcaaactccccccaccccctttccaaagcccattccctc

SEQ ID NO: 2819 - DNA, 58 bp, Artificial Sequence
  Description of Artificial Sequence: Synthetic VEGFA target binding site sequence
tgggaggtcagaaatagggggtccaggaccccaccccctttccaaagcccattccctc

SEQ ID NO: 2820 - DNA, 59 bp, Artificial Sequence
  Description of Artificial Sequence: Synthetic VEGFA target binding site sequence
  modified_base (28)..(28): a, c, t, g, unknown or other
tgggaggtcagaaatagggggtccaggncccccaccccctttccaaagcccattccctc

SEQ ID NO: 2821 - DNA, 60 bp, Artificial Sequence
  Description of Artificial Sequence: Synthetic VEGFA target binding site sequence
tgggaggtcagaaatagggggtccagctggccccaccccctttccaaagcccattccctc

SEQ ID NO: 2822 - DNA, 61 bp, Artificial Sequence
  Description of Artificial Sequence: Synthetic VEGFA target binding site sequence
tgggaggtcagaaatagggggtccaaactccccccaccccctttccaaagcccattccctc

SEQ ID NO: 2823 - DNA, 61 bp, Artificial Sequence
  Description of Artificial Sequence: Synthetic VEGFA target binding site sequence
  modified_base (11)..(11): a, c, t, g, unknown or other
tgggaggtcanaaatagggggtccagactccccccaccccctttccaaagcccattccctc

SEQ ID NO: 2824 - DNA, 62 bp, Artificial Sequence
  Description of Artificial Sequence: Synthetic VEGFA target binding site sequence
tgggaggtcagaaatagggggtccaggactccccccaccccctttccaaagcccattccctc

SEQ ID NO: 2825 - DNA, 64 bp, Artificial Sequence
  Description of Artificial Sequence: Synthetic VEGFA target binding site sequence
  modified_base (48)..(53): a, c, t, g, unknown or other
  modified_base (60)..(62): a, c, t, g, unknown or other
tgggaggtcagaaatagggggtccagcaaactccccccaccccctttnnnnnncccattnnntc

SEQ ID NO: 2826 - DNA, 65 bp, Artificial Sequence
  Description of Artificial Sequence: Synthetic VEGFA target binding site sequence
  modified_base (3)..(3): a, c, t, g, unknown or other
tgngaggtcagaaatagggggtccaggaaaactccccccaccccctttccaaagcccattccctc

SEQ ID NO: 2827 - DNA, 44 bp, Artificial Sequence
  Description of Artificial Sequence: Synthetic VEGFA target binding site sequence
tgggaggtcaccccctttccaaagcccaccccctttccaaagcc

SEQ ID NO: 2828 - DNA, 67 bp, Artificial Sequence
  Description of Artificial Sequence: Synthetic VEGFA target binding site sequence
tgggaggtcagaaatagggggtccaggaaagcaaactccccccaccccctttccaaagcccattccc

SEQ ID NO: 2829 - DNA, 67 bp, Artificial Sequence
  Description of Artificial Sequence: Synthetic VEGFA target binding site sequence
gaggacgtgtgtgtctgtgtgggtgagtgagtgtgtgcgtgtggggttgagggtgttggagcgggga

SEQ ID NO: 2830 - DNA, 21 bp, Artificial Sequence
  Description of Artificial Sequence: Synthetic VEGFA target binding site sequence
gaggacgtgtgtgtctgtgtg

SEQ ID NO: 2831 - DNA, 17 bp, Artificial Sequence
  Description of Artificial Sequence: Synthetic VEGFA target binding site sequence
gaggacgtgtgtgttgg

SEQ ID NO: 2832 - DNA, 21 bp, Artificial Sequence
  Description of Artificial Sequence: Synthetic VEGFA target binding site sequence
gaggacgtgtgtgtctgtgtg

SEQ ID NO: 2833 - DNA, 21 bp, Artificial Sequence
  Description of Artificial Sequence: Synthetic VEGFA target binding site sequence
gaggacgtgtgtgtctgtgtg

SEQ ID NO: 2834 - DNA, 37 bp, Artificial Sequence
  Description of Artificial Sequence: Synthetic VEGFA target binding site sequence
gaggacgtgtgtgtctgtgtgggtgagtgagtgtgtg

SEQ ID NO: 2835 - DNA, 29 bp, Artificial Sequence
  Description of Artificial Sequence: Synthetic VEGFA target binding site sequence
gaggacgtgtgtgtctgtgtgggtgagtg

SEQ ID NO: 2836 - DNA, 28 bp, Artificial Sequence
  Description of Artificial Sequence: Synthetic VEGFA target binding site sequence
gaggacgtgtgtgtctgtgtgagtggga

SEQ ID NO: 2837 - DNA, 37 bp, Artificial Sequence
  Description of Artificial Sequence: Synthetic VEGFA target binding site sequence
  modified_base (35)..(36): a, c, t, g, unknown or other
gaggacgtgtgtgtctgtgtgggtgagtgagtgtnng

SEQ ID NO: 2838 - DNA, 37 bp, Artificial Sequence
  Description of Artificial Sequence: Synthetic VEGFA target binding site sequence
  modified_base (32)..(32): a, c, t, g, unknown or other
  modified_base (34)..(34): a, c, t, g, unknown or other
  modified_base (37)..(37): a, c, t, g, unknown or other
gaggacgtgtgtgtctgtgtgggtgagtgagngnggn

SEQ ID NO: 2839 - DNA, 42 bp, Artificial Sequence
  Description of Artificial Sequence: Synthetic VEGFA target binding site sequence
gaggacgtgtgtgtctgtgtgggtgagtgagtggggcgggga

SEQ ID NO: 2840 - DNA, 44 bp, Artificial Sequence
  Description of Artificial Sequence: Synthetic VEGFA target binding site sequence
gaggacgtgtgtgtctgtgtgggtgagtgagtgtggagcgggga

SEQ ID NO: 2841 - DNA, 45 bp, Artificial Sequence
  Description of Artificial Sequence: Synthetic VEGFA target binding site sequence
gaggacgtgtgtgtctgtgtgggtgagtgagtgttggagcgggga

SEQ ID NO: 2842 - DNA, 47 bp, Artificial Sequence
  Description of Artificial Sequence: Synthetic VEGFA target binding site sequence
gaggacgtgtgtgtctgtgtgggtgagtgagtgtgttggagcgggga

SEQ ID NO: 2843 - DNA, 47 bp, Artificial Sequence
  Description of Artificial Sequence: Synthetic VEGFA target binding site sequence
gaggacgtgtgtgtctgtgtgggtgagtgagggtgttggagcgggga

SEQ ID NO: 2844 - DNA, 49 bp, Artificial Sequence
  Description of Artificial Sequence: Synthetic VEGFA target binding site sequence
gaggacgtgtgtgtctgtgtgggtgagtgagtgggcgttggagcgggga

SEQ ID NO: 2845 - DNA, 55 bp, Artificial Sequence
  Description of Artificial Sequence: Synthetic VEGFA target binding site sequence
  modified_base (27)..(28): a, c, t, g, unknown or other
gaggacgtgtgtgtctgtgtgggtganngtggggttgagggtgttggagcgggga

SEQ ID NO: 2846 - DNA, 59 bp, Artificial Sequence
  Description of Artificial Sequence: Synthetic VEGFA target binding site sequence
gaggacgtgtgtgtctgtgtgggtgagtgagtgtggggttgagggcgttggagcgggga

SEQ ID NO: 2847 - DNA, 60 bp, Artificial Sequence
  Description of Artificial Sequence: Synthetic VEGFA target binding site sequence
gaggacgtgtgtgtctgtgtgggtgagtgagtgtgtgggttgagggcgttggagcgggga

SEQ ID NO: 2848 - DNA, 60 bp, Artificial Sequence
  Description of Artificial Sequence: Synthetic VEGFA target binding site sequence
gaggacgtgtgtgtctgtgtggtgagtgagtgtgtggggttgagggtgttggagcgggga

SEQ ID NO: 2849 - DNA, 61 bp, Artificial Sequence
  Description of Artificial Sequence: Synthetic VEGFA target binding site sequence
  modified_base (34)..(34): a, c, t, g, unknown or other
gaggacgtgtgtgtctgtgtgggtgagtgagtgngtggggttgagggtgttggagcgggga

SEQ ID NO: 2850 - DNA, 63 bp, Artificial Sequence
  Description of Artificial Sequence: Synthetic VEGFA target binding site sequence
gaggacgtgtgtgtctgtgtgggtgagtgagtgtgtgtggggttgagggtgttggagcgggga

SEQ ID NO: 2851 - DNA, 64 bp, Artificial Sequence
  Description of Artificial Sequence: Synthetic VEGFA target binding site sequence
gaggacgtgtgtgtctgtgtgggtgagtgagtgtgtgctggggttgagggtgttggagcgggga

SEQ ID NO: 2852 - DNA, 67 bp, Artificial Sequence
  Description of Artificial Sequence: Synthetic VEGFA target binding site sequence
  modified_base (6)..(6): a, c, t, g, unknown or other
  modified_base (8)..(8): a, c, t, g, unknown or other
gaggangngtgtgtctgtgtgggtgagtgagtgtgtgtgggtgagtgagtgtgtgtctgtggggttg

SEQ ID NO: 2853 - DNA, 67 bp, Artificial Sequence
  Description of Artificial Sequence: Synthetic VEGFA target binding site sequence
gaggacgtgtgtgtctgtgtgggtgagtgagtgtgtgcgtcgtgtggggttgagggtgttggagcgg

SEQ ID NO: 2854 - DNA, 67 bp, Artificial Sequence
  Description of Artificial Sequence: Synthetic VEGFA target binding site sequence
gaggacgtgtgtgtctgtgtgggtgagtgagtgtgtgcaaagtgtggggttgagggtgttggagcgg

SEQ ID NO: 2855 - DNA, 67 bp, Artificial Sequence
  Description of Artificial Sequence: Synthetic VEGFA target binding site sequence
gaggacgtgtgtgtctgtgtgggtgagtgagtgtgtgcgtgtgcggggttgagggtgttggagcggg

SEQ ID NO: 2856 - DNA, 67 bp, Artificial Sequence
  Description of Artificial Sequence: Synthetic VEGFA target binding site sequence
tgaggacgtgtgtgtctgtgtgggtgagtgagtgtgtgcgtgtggggttgagggtgttggagcgggg

SEQ ID NO: 2857 - DNA, 21 bp, Artificial Sequence
  Description of Artificial Sequence: Synthetic VEGFA target binding site sequence
gggaggtcagaaatagggggt

SEQ ID NO: 2858 - DNA, 38 bp, Artificial Sequence
  Description of Artificial Sequence: Synthetic VEGFA target binding site sequence
tgaggacgtgtgtgtctgtgtgggtgagtgagtgtgtg

SEQ ID NO: 2859 - DNA, 15 bp, Artificial Sequence
  Description of Artificial Sequence: Synthetic VEGFA target binding site sequence
tgaggacgtgtgtgt

SEQ ID NO: 2860 - DNA, 38 bp, Artificial Sequence
  Description of Artificial Sequence: Synthetic VEGFA target binding site sequence
  modified_base (28)..(29): a, c, t, g, unknown or other
  modified_base (32)..(33): a, c, t, g, unknown or other
  modified_base (35)..(35): a, c, t, g, unknown or other
  modified_base (37)..(37): a, c, t, g, unknown or other
tgaggacgtgtgtgtctgtgtgggagannganngngng

SEQ ID NO: 2861 - DNA, 14 bp, Artificial Sequence
  Description of Artificial Sequence: Synthetic VEGFA target binding site sequence
tgaggacgtgtgtg

SEQ ID NO: 2862 - DNA, 23 bp, Artificial Sequence
  Description of Artificial Sequence: Synthetic VEGFA target binding site sequence
tgaggacgtgtgtgtctgtgtgg

SEQ ID NO: 2863 - DNA, 17 bp, Artificial Sequence
  Description of Artificial Sequence: Synthetic VEGFA target binding site sequence
tgaggacgtgtgtgtgg

SEQ ID NO: 2864 - DNA, 30 bp, Artificial Sequence
  Description of Artificial Sequence: Synthetic VEGFA target binding site sequence
tgaggacgtgtgtgtctgtgtgggtgagtg

SEQ ID NO: 2865 - DNA, 29 bp, Artificial Sequence
  Description of Artificial Sequence: Synthetic VEGFA target binding site sequence
tgaggacgtgtgtgtctgtgtgggtgagg

SEQ ID NO: 2866 - DNA, 30 bp, Artificial Sequence; identical to SEQ ID NO: 2864
  Description of Artificial Sequence: Synthetic VEGFA target binding site sequence

SEQ ID NO: 2867 - DNA, 40 bp, Artificial Sequence
  Description of Artificial Sequence: Synthetic VEGFA target binding site sequence
tgaggacgtgtgtgtctgtgtgggtgagtgaggagcgggg

SEQ ID NO: 2868 - DNA, 43 bp, Artificial Sequence
  Description of Artificial Sequence: Synthetic VEGFA target binding site sequence
tgaggacgtgtgtgtctgtgtgggtgagtgagttggagcgggg

SEQ ID NO: 2869 - DNA, 43 bp, Artificial Sequence
  Description of Artificial Sequence: Synthetic VEGFA target binding site sequence
tgaggacgtgtgtgtctgtgtgggtgagtgtgttggagcgggg

SEQ ID NO: 2870 - DNA, 45 bp, Artificial Sequence
  Description of Artificial Sequence: Synthetic VEGFA target binding site sequence
tgaggacgtgtgtgtctgtgtggggttgagggcgttggagcgggg

SEQ ID NO: 2871 - DNA, 45 bp, Artificial Sequence
  Description of Artificial Sequence: Synthetic VEGFA target binding site sequence
tgaggacgtgtgtgtctgtgtgggtgagtgagtgttggagcgggg

SEQ ID NO: 2872 - DNA, 47 bp, Artificial Sequence
  Description of Artificial Sequence: Synthetic VEGFA target binding site sequence
tgaggacgtgtgtgtctgtgtgggtgagtgagtgtgttggagcgggg

SEQ ID NO: 2873 - DNA, 47 bp, Artificial Sequence
  Description of Artificial Sequence: Synthetic VEGFA target binding site sequence
tgaggacgtgtgtgtctgtgtgggtgagtgagggcgttggagcgggg

SEQ ID NO: 2874 - DNA, 52 bp, Artificial Sequence
  Description of Artificial Sequence: Synthetic VEGFA target binding site sequence
tgaggacgtgtgtgtctgtgtgggtgagtgagttgagggtgttggagcgggg

SEQ ID NO: 2875 - DNA, 54 bp, Artificial Sequence
  Description of Artificial Sequence: Synthetic VEGFA target binding site sequence
tgaggacgtgtgtgtctgtgtgggtgagtgagtgttgagggcgttggagcgggg

SEQ ID NO: 2876 - DNA, 56 bp, Artificial Sequence
  Description of Artificial Sequence: Synthetic VEGFA target binding site sequence
tgaggacgtgtgtgtctgtgtgggtgagtgagtgtgttgagggcgttggagcgggg

SEQ ID NO: 2877 - DNA, 58 bp, Artificial Sequence
  Description of Artificial Sequence: Synthetic VEGFA target binding site sequence
  modified_base (30)..(32): a, c, t, g, unknown or other
  modified_base (39)..(40): a, c, t, g, unknown or other
  modified_base (43)..(43): a, c, t, g, unknown or other
  modified_base (46)..(46): a, c, t, g, unknown or other
  modified_base (51)..(55): a, c, t, g, unknown or other
tgaggacgtgtgtgtctgtgtgggtgagtnnnggggggnnganggngttgnnnnnggg

SEQ ID NO: 2878 - DNA, 58 bp, Artificial Sequence
  Description of Artificial Sequence: Synthetic VEGFA target binding site sequence
  modified_base (32)..(34): a, c, t, g, unknown or other
  modified_base (39)..(39): a, c, t, g, unknown or other
tgaggacgtgtgtgtctgtgtgggtgagtgannnggggntgagggtgttggagcgggg

SEQ ID NO: 2879 - DNA, 59 bp, Artificial Sequence
  Description of Artificial Sequence: Synthetic VEGFA target binding site sequence
  modified_base (48)..(48): a, c, t, g, unknown or other
  modified_base (51)..(56): a, c, t, g, unknown or other
tgaggacgtgtgtgtctgtgtgggtgagtgagtgtggggttgaggggntgnnnnnnggg

SEQ ID NO: 2880 - DNA, 60 bp, Artificial Sequence
  Description of Artificial Sequence: Synthetic VEGFA target binding site sequence
tgaggacgtgtgtgtctgtgtgggtgagtgagtgtgtgggttgagggcgttggagcgggg

SEQ ID NO: 2881 - DNA, 61 bp, Artificial Sequence
  Description of Artificial Sequence: Synthetic VEGFA target binding site sequence
tgaggacgtgtgtgtctgtgtgggtgagtgagtgtgtggggttgagggtgttggagcgggg

SEQ ID NO: 2882 - DNA, 61 bp, Artificial Sequence
  Description of Artificial Sequence: Synthetic VEGFA target binding site sequence
  modified_base (39)..(39): a, c, t, g, unknown or other
  modified_base (42)..(42): a, c, t, g, unknown or other
  modified_base (45)..(45): a, c, t, g, unknown or other
  modified_base (52)..(52): a, c, t, g, unknown or other
  modified_base (57)..(58): a, c, t, g, unknown or other
tgaggacgtgtgtgtctgtgtgggtgagtgagtgtgtgnggntgnggttganggagnngga

SEQ ID NO: 2883 - DNA, 63 bp, Artificial Sequence
  Description of Artificial Sequence: Synthetic VEGFA target binding site sequence
tgaggacgtgtgtgtctgtgtgggtgagtgagtgtgtgtggggttgagggtgttggagcgggg

SEQ ID NO: 2884 - DNA, 63 bp, Artificial Sequence
  Description of Artificial Sequence: Synthetic VEGFA target binding site sequence
tgaggacgtgtgtgtctgtgtgggtgagtgagtgcgtgtggggttgagggtgttggagcgggg

SEQ ID NO: 2885 - DNA, 65 bp, Artificial Sequence
  Description of Artificial Sequence: Synthetic VEGFA target binding site sequence
tgaggacgtgtgtgtctgtgtgggtgagtgagtgagtgtgtggggttgagggcgttggagcgggg

SEQ ID NO: 2886 - DNA, 67 bp, Artificial Sequence
  Description of Artificial Sequence: Synthetic VEGFA target binding site sequence
  modified_base (43)..(43): a, c, t, g, unknown or other
tgaggacgtgtgtgtctgtgtgggtgagtgagtgagtgagtgngtggggttgagggcgttggagcgg

SEQ ID NO: 2887 - DNA, 67 bp, Artificial Sequence
  Description of Artificial Sequence: Synthetic VEGFA target binding site sequence
tgaggacgtgtgtgtctgtgtgggtgagtgagtgtgtgctcgtgtggggttgagggcgttggagcgg

SEQ ID NO: 2888 - DNA, 330 bp, Artificial Sequence
  Description of Artificial Sequence: Synthetic VEGFA target binding site oligonucleotide
  modified_base (28)..(28): a, c, t, g, unknown or other
  modified_base (30)..(30): a, c, t, g, unknown or other
  modified_base (32)..(32): a, c, t, g, unknown or other
  modified_base (42)..(44): a, c, t, g, unknown or other
  modified_base (50)..(50): a, c, t, g, unknown or other
  modified_base (54)..(54): a, c, t, g, unknown or other
  modified_base (57)..(58): a, c, t, g, unknown or other
  modified_base (60)..(60): a, c, t, g, unknown or other
  modified_base (197)..(197): a, c, t, g, unknown or other
  modified_base (199)..(201): a, c, t, g, unknown or other
  modified_base (210)..(215): a, c, t, g, unknown or other
  modified_base (219)..(221): a, c, t, g, unknown or other
  modified_base (223)..(224): a, c, t, g, unknown or other
  modified_base (229)..(229): a, c, t, g, unknown or other
  modified_base (256)..(256): a, c, t, g, unknown or other
gggtgaatggagcgagcagcgtcttcgngngngaggacgtgnnngtctgngtgngtnngngagtgtgtgctagggttagggttagggttagggttagggttagggttagggttagggttagggttagggttagggttagggttagggttagggttagggttagggttagggttagggttagggttagggttagggtnannnttagggttnnnnnnaggnnnanngttanggttagggttagggttagggttagggntagggttagggttagggttagggttagggttagggttagggttagggtgtgtggggttgagggcgttggagcgg

SEQ ID NO: 2889 - DNA, 64 bp, Artificial Sequence
  Description of Artificial Sequence: Synthetic VEGFA target binding site sequence
gattgcctttactccatgcctttcttctgctctaactctgacaatctgtcttgccatgccataa

SEQ ID NO: 2890 - DNA, 20 bp, Artificial Sequence
  Description of Artificial Sequence: Synthetic VEGFA target binding site sequence
tggggggagtttgctcctgg

SEQ ID NO: 2891 - DNA, 21 bp, Artificial Sequence
  Description of Artificial Sequence: Synthetic VEGFA target binding site sequence
gtggggggagtttgctcctgg

SEQ ID NO: 2892 - DNA, 23 bp, Artificial Sequence
  Description of Artificial Sequence: Synthetic VEGFA target binding site sequence
gggtggggggagtttgctcctgg

SEQ ID NO: 2893 - DNA, 20 bp, Artificial Sequence
  Description of Artificial Sequence: Synthetic VEGFA target binding site sequence
gagtgagtgtgtgcgtgtgg

SEQ ID NO: 2894 - DNA, 21 bp, Artificial Sequence
  Description of Artificial Sequence: Synthetic VEGFA target binding site sequence
tgagtgagtgtgtgcgtgtgg

SEQ ID NO: 2895 - DNA, 23 bp, Artificial Sequence
  Description of Artificial Sequence: Synthetic VEGFA target binding site sequence
ggtgagtgagtgtgtgcgtgtgg

SEQ ID NO: 2896 - DNA, 20 bp, Artificial Sequence
  Description of Artificial Sequence: Synthetic EMX1 target binding oligonucleotide
tccgagcagaagaagaaggg

SEQ ID NO: 2897 - DNA, 21 bp, Artificial Sequence
  Description of Artificial Sequence: Synthetic EMX1 target binding oligonucleotide
gtccgagcagaagaagaaggg

SEQ ID NO: 2898 - DNA, 23 bp, Artificial Sequence
  Description of Artificial Sequence: Synthetic EMX1 target binding oligonucleotide
gagtccgagcagaagaagaaggg

SEQ ID NO: 2899 - DNA, 67 bp, Artificial Sequence
  Description of Artificial Sequence: Synthetic VEGFA target binding site sequence
agacaggacattctgacaccccaggagcaaactccctccatcccacaaatccgtccttagatgtgca

SEQ ID NO: 2900 - DNA, 38 bp, Artificial Sequence
  Description of Artificial Sequence: Synthetic VEGFA target binding site sequence
aactccctccatcccacaaatccgtccttagatgtgca

SEQ ID NO: 2901 - DNA, 50 bp, Artificial Sequence
  Description of Artificial Sequence: Synthetic VEGFA target binding site sequence
agacaggacattctgacaccccatcccacaaatccgtccttagatgtgca

SEQ ID NO: 2902 - DNA, 52 bp, Artificial Sequence
  Description of Artificial Sequence: Synthetic VEGFA target binding site sequence
agacaggacattctgacaccccaggacccacaaatccgtccttagatgtgca

SEQ ID NO: 2903 - DNA, 65 bp, Artificial Sequence
  Description of Artificial Sequence: Synthetic VEGFA target binding site sequence
agacaggacattctgacaccccaggcaaactccctccatcccacaaatccgtccttagatgtgca

SEQ ID NO: 2904 - DNA, 69 bp, Artificial Sequence
  Description of Artificial Sequence: Synthetic VEGFA target binding site sequence
agacaggacattctgacaccccaggagggcaaactccctccatcccacaaatccgtccttagatgtgca

SEQ ID NO: 2905 - DNA, 66 bp, Artificial Sequence
  Description of Artificial Sequence: Synthetic VEGFA target binding site sequence
gagagaggctcccatcacgggggagggagtttgctcctggggaacctgtgatccccacagggaaca

SEQ ID NO: 2906 - DNA, 31 bp, Artificial Sequence
  Description of Artificial Sequence: Synthetic VEGFA target binding site sequence
gagagaggctcccatcacgggggagggaaca

SEQ ID NO: 2907 - DNA, 52 bp, Artificial Sequence
  Description of Artificial Sequence: Synthetic VEGFA target binding site sequence
gagagaggctcccatcacgggggaggggaacctgtgatccccacagggaaca

SEQ ID NO: 2908 - DNA, 67 bp, Artificial Sequence
  Description of Artificial Sequence: Synthetic VEGFA target binding site sequence
tggactctacccactgaatgccaggagcaaacttcccctccccgagttgtgacagcaaaaatgtctc

SEQ ID NO: 2909 - DNA, 24 bp, Artificial Sequence
  Description of Artificial Sequence: Synthetic VEGFA target binding site sequence
tggactctacccactgaatgtctc

SEQ ID NO: 2910 - DNA, 42 bp, Artificial Sequence
  Description of Artificial Sequence: Synthetic VEGFA target binding site sequence
tggactctacccctccccgagttgtgacagcaaaaatgtctc

SEQ ID NO: 2911 - DNA, 43 bp, Artificial Sequence
  Description of Artificial Sequence: Synthetic VEGFA target binding site sequence
tggactctaccccctccccgagttgtgacagcaaaaatgtctc

SEQ ID NO: 2912 - DNA, 52 bp, Artificial Sequence
  Description of Artificial Sequence: Synthetic VEGFA target binding site sequence
tggactctacccactgaatgccctccccgagttgtgacagcaaaaatgtctc

SEQ ID NO: 2913 - DNA, 52 bp, Artificial Sequence; identical to SEQ ID NO: 2912
  Description of Artificial Sequence: Synthetic VEGFA target binding site sequence

SEQ ID NO: 2914 - DNA, 60 bp, Artificial Sequence
  Description of Artificial Sequence: Synthetic VEGFA target binding site sequence
tggactctacccactgaatgcaaacttcccctccccgagttgtgacagcaaaaatgtctc

SEQ ID NO: 2915 - DNA, 61 bp, Artificial Sequence
  Description of Artificial Sequence: Synthetic VEGFA target binding site sequence
tggactctacccactgaatgccaggattcccctccccgagttgtgacagcaaaaatgtctc

SEQ ID NO: 2916 - DNA, 61 bp, Artificial Sequence
  Description of Artificial Sequence: Synthetic VEGFA target binding site sequence
tggactctacccactgaatgcctggcatcccctccccgagttgtgacagcaaaaatgtctc

SEQ ID NO: 2917 - DNA, 64 bp, Artificial Sequence
  Description of Artificial Sequence: Synthetic VEGFA target binding site sequence
tggactctacccactgaatgccaggaaacttcccctccccgagttgtgacagcaaaaatgtctc

SEQ ID NO: 2918 - DNA, 226 bp, Artificial Sequence
  Description of Artificial Sequence: Synthetic VEGFA target binding site sequence
tggactctacccactgaatgccaggatggaagataattttttccatagaccagggtgggggaatggtttcgggatgattcaagcacatcacatttattgtgcactttatttctattactattatattgtaatgtatactaaaaataattatacaactcaccataatgtagaaccagtgggagccgcaaacttcccctccccgagttgtgacagcaaaaatgtctca

SEQ ID NO: 2919 - DNA, 112 bp, Artificial Sequence
  Description of Artificial Sequence: Synthetic VEGFA target binding site sequence
tggactctacccactgaatgccaggcaaacttcccctccccgagttgtgacagcaaaaatgtctggcctaatgtctggcaaaaatgtctcaagacattgccaaatgtcccct

SEQ ID NO: 2920 - DNA, 67 bp, Artificial Sequence
  Description of Artificial Sequence: Synthetic VEGFA target binding site sequence
acccacctccctatcctcaaaacttggccagaggcggggtggaggggcccctaggagcgccttggtg

SEQ ID NO: 2921 - DNA, 16 bp, Artificial Sequence
  Description of Artificial Sequence: Synthetic VEGFA target binding site sequence
acccaccgccttggtg

SEQ ID NO: 2922 - DNA, 31 bp, Artificial Sequence
  Description of Artificial Sequence: Synthetic VEGFA target binding site sequence
acccacctcctatcctaggagcgccttggtg

SEQ ID NO: 2923 - DNA, 34 bp, Artificial Sequence
  Description of Artificial Sequence: Synthetic VEGFA target binding site sequence
acccacctccctatcctcaaaacttcccttggtg

SEQ ID NO: 2924 - DNA, 49 bp, Artificial Sequence
  Description of Artificial Sequence: Synthetic VEGFA target binding site sequence
acccacctccctatcctcaaaacttggccagagtaggagcgccttggtg

SEQ ID NO: 2925 - DNA, 57 bp, Artificial Sequence
  Description of Artificial Sequence: Synthetic VEGFA target binding site sequence
acccacctccctatcctcaaaacttggggtggaggggcccctaggagcgccttggtg

SEQ ID NO: 2926 - DNA, 60 bp, Artificial Sequence
  Description of Artificial Sequence: Synthetic VEGFA target binding site sequence
acccacctccctatcctcaaaacttggcgggttggaggggcccctaggagcgccttggtg

SEQ ID NO: 2927 - DNA, 61 bp, Artificial Sequence
  Description of Artificial Sequence: Synthetic VEGFA target binding site sequence
acccacctccctatcctcaaaacttggccagagtggaggggcccctaggagcgccttggtg

SEQ ID NO: 2928 - DNA, 87 bp, Artificial Sequence
  Description of Artificial Sequence: Synthetic VEGFA target binding site sequence
acccacctccctatcctcaaaactctggcagtctgtcagtgcgttatcttgtcacacttctacaagggggctctccctgcattctga

SEQ ID NO: 2929 - DNA, 175 bp, Artificial Sequence
  Description of Artificial Sequence: Synthetic VEGFA target binding site sequence
acccacctccctatcctcaaaacttggccagagggcgcctccccaggaagtgctccggccagcccagggtaaacacgctagccctgcccctctgggaccatagcccggggacccagactcttggccacgctcattcccaccgcggggtggaggggcccctaggagcgccttggtg

SEQ ID NO: 2930 - DNA, 67 bp, Artificial Sequence
  Description of Artificial Sequence: Synthetic VEGFA target binding site sequence
tgactgtcggtgccccacatgtggcagatgcccagaggcggggtgtggggggtactttgtgggcgtt

SEQ ID NO: 2931 - DNA, 34 bp, Artificial Sequence
  Description of Artificial Sequence: Synthetic VEGFA target binding site sequence
tgactgtcggtgtggggggtactttgtgggcgtt

SEQ ID NO: 2932 - DNA, 44 bp, Artificial Sequence
  Description of Artificial Sequence: Synthetic VEGFA target binding site sequence
tgactgtcggtgccccacatgtggcagatgcccagaggggcgtt

SEQ ID NO: 2933 - DNA, 52 bp, Artificial Sequence
  Description of Artificial Sequence: Synthetic VEGFA target binding site sequence
tgactgtcggtgccccacatgtggcagatgtggggggtactttgtgggcgtt

SEQ ID NO: 2934 - DNA, 53 bp, Artificial Sequence
  Description of Artificial Sequence: Synthetic VEGFA target binding site sequence
tgactgtcggtgccccacatgtggcggggtgtggggggtactttgtgggcgtt

SEQ ID NO: 2935 - DNA, 63 bp, Artificial Sequence
  Description of Artificial Sequence: Synthetic VEGFA target binding site sequence
tgactgtcggtgccccacatgtggcagatggaggcggggtgtggggggtactttgtgggcgtt

SEQ ID NO: 2936 - DNA, 63 bp, Artificial Sequence
  Description of Artificial Sequence: Synthetic VEGFA target binding site sequence
tgactgtcggtgccccacatgtggcagatgcccagagggtgtggggggtactttgtgggcgtt

SEQ ID NO: 2937 - DNA, 65 bp, Artificial Sequence
  Description of Artificial Sequence: Synthetic VEGFA target binding site sequence
tgactgtcggtgccccacatgtggcagatgcccagagggggtgtggggggtactttgtgggcgtt

SEQ ID NO: 2938 - DNA, 69 bp, Artificial Sequence
  Description of Artificial Sequence: Synthetic VEGFA target binding site sequence
tgactgtcggtgccccacatgtggcagatgcccagagttgcggggtgtggggggtactttgtgggcgtt

SEQ ID NO: 2939 - DNA, 71 bp, Artificial Sequence
  Description of Artificial Sequence: Synthetic VEGFA target binding site sequence
tgactgtcggtgccccacatgtggcagatgcccagagctgcgcggggtgtggggggtactttgtgggcgtt

SEQ ID NO: 2940 - DNA, 67 bp, Artificial Sequence
  Description of Artificial Sequence: Synthetic VEGFA target binding site sequence
acaagatgactatgtccctctgggccccatcctcccctccccacccaccccgcctcaggcttgaaga

SEQ ID NO: 2941 - DNA, 6 bp, Artificial Sequence
  Description of Artificial Sequence: Synthetic VEGFA target binding site sequence
acaaga

SEQ ID NO: 2942 - DNA, 14 bp, Artificial Sequence
  Description of Artificial Sequence: Synthetic VEGFA target binding site sequence
ctcaggcttgaaga

SEQ ID NO: 2943 - DNA, 8 bp, Artificial Sequence
  Description of Artificial Sequence: Synthetic VEGFA target binding site sequence
acaagatg

SEQ ID NO: 2944 - DNA, 35 bp, Artificial Sequence
  Description of Artificial Sequence: Synthetic VEGFA target binding site sequence
acaagatgactatgtccctctgggccccatcctcc

SEQ ID NO: 2945 - DNA, 33 bp, Artificial Sequence
  Description of Artificial Sequence: Synthetic VEGFA target binding site sequence
acaagatgactatgtccctctgggccttgaaga

SEQ ID NO: 2946 - DNA, 53 bp, Artificial Sequence
  Description of Artificial Sequence: Synthetic VEGFA target binding site sequence
acaagatgactatgtccctctgggccccatcctcccctccccaggcttgaaga

SEQ ID NO: 2947 - DNA, 55 bp, Artificial Sequence
  Description of Artificial Sequence: Synthetic VEGFA target binding site sequence
acaagatgactatgtccctctgggccccatcctcccctcccctcaggcttgaaga

SEQ ID NO: 2948 - DNA, 56 bp, Artificial Sequence
  Description of Artificial Sequence: Synthetic VEGFA target binding site sequence
acaagatgactatgtccctctgggccccatcctcccctccccagcaggcttgaaga

SEQ ID NO: 2949 - DNA, 56 bp, Artificial Sequence
  Description of Artificial Sequence: Synthetic VEGFA target binding site sequence
acaagatgactatgtccctctgggccccatcctcccctccccacccaccttgaaga

SEQ ID NO: 2950 - DNA, 56 bp, Artificial Sequence
  Description of Artificial Sequence: Synthetic VEGFA target binding site sequence
acaagatgactatgtccctctgggccccatcctcccctcccgctcaggcttgaaga

SEQ ID NO: 2951 - DNA, 214 bp, Artificial Sequence
  Description of Artificial Sequence: Synthetic VEGFA target binding site sequence
acaagatgactatgtccctctgggcccgcctcaagtgatccagctgccttggcctccaaaagtgctagcagtacagatgtgagcctccatgcctggcctattgcaacatcccatctctgtgaagcagggttttctgcagtgacagcaagaagagcacagggccaaaaaaactttgtcctttagaaaggatctaccttttaggctgagaatggca

SEQ ID NO: 2952 - DNA, 67 bp, Artificial Sequence
  Description of Artificial Sequence: Synthetic VEGFA target binding site sequence
gagtgagagagcgagtgagtgagtgagtgagtgtgtgtgtgggggggactcggcttgttgttgtcgg

SEQ ID NO: 2953 - DNA, 63 bp, Artificial Sequence
  Description of Artificial Sequence: Synthetic VEGFA target binding site sequence
gagtgagagagcgagtgagtgagtgagtgagtgtgtgggggggactcggcttgttgttgtcgg

SEQ ID NO: 2954 - DNA, 61 bp, Artificial Sequence
  Description of Artificial Sequence: Synthetic VEGFA target binding site sequence
gagtgagagagcgagtgagtgagtgagtgagtgtgggggggactcggcttgttgttgtcgg

SEQ ID NO: 2955 - DNA, 67 bp, Artificial Sequence
  Description of Artificial Sequence: Synthetic VEGFA target binding site sequence
gtgttgggatgcgggagtgggtgagtgagtgcgtgcgggtggcgatgcaagcgtgtgcgaatgcgtg

SEQ ID NO: 2956 - DNA, 16 bp, Artificial Sequence
  Description of Artificial Sequence: Synthetic VEGFA target binding site sequence
gtgttgggatgcggga

SEQ ID NO: 2957 - DNA, 17 bp, Artificial Sequence
  Description of Artificial Sequence: Synthetic VEGFA target binding site sequence
gtgttgggatgcgcgtg

SEQ ID NO: 2958 - DNA, 57 bp, Artificial Sequence
  Description of Artificial Sequence: Synthetic VEGFA target binding site sequence
gtgttgggatgcgggagtgggtgagtgagtggcgatgcaagcgtgtgcgaatgcgtg

SEQ ID NO: 2959 - DNA, 69 bp, Artificial Sequence
  Description of Artificial Sequence: Synthetic VEGFA target binding site sequence
gtgttgggatgcgggagtgggtgagtgagtgcaagtgcgggtggcgatgcaagcgtgtgcgaatgcgtg

SEQ ID NO: 2960 - DNA, 67 bp, Artificial Sequence
  Description of Artificial Sequence: Synthetic VEGFA target binding site sequence
tttcaaagacagtagatcttaaatgtcctcacgcacacactcacccacacataaaaggtggtaactg

SEQ ID NO: 2961 - DNA, 35 bp, Artificial Sequence
  Description of Artificial Sequence: Synthetic VEGFA target binding site sequence
tttcaaagacagtagatcttaaaaggtggtaactg

SEQ ID NO: 2962 - DNA, 44 bp, Artificial Sequence
  Description of Artificial Sequence: Synthetic VEGFA target binding site sequence
tttcaaagacagtagatcttaaatgtcataaaaggtggtaactg

SEQ ID NO: 2963 - DNA, 49 bp, Artificial Sequence
  Description of Artificial Sequence: Synthetic VEGFA target binding site sequence
tttcaaagacagtagatcttaaatgtcctcacataaaaggtggtaactg

SEQ ID NO: 2964 - DNA, 52 bp, Artificial Sequence
  Description of Artificial Sequence: Synthetic VEGFA target binding site sequence
tttcaaagacagtagatcttaaatgtcctccacacataaaaggtggtaactg

SEQ ID NO: 2965 - DNA, 55 bp, Artificial Sequence
  Description of Artificial Sequence: Synthetic VEGFA target binding site sequence
tttcaaagacagtagatcttaaatgtcctcacccacacataaaaggtggtaactg

SEQ ID NO: 2966 - DNA, 65 bp, Artificial Sequence
  Description of Artificial Sequence: Synthetic VEGFA target binding site sequence
tttcaaagacagtagatcttaaatgtcctcacacacactcacccacacataaaaggtggtaactg

SEQ ID NO: 2967 - DNA, 128 bp, Artificial Sequence
  Description of Artificial Sequence: Synthetic VEGFA target binding site sequence
tttcaaagacagtagatcttaaatgtcctcacaggctggagtacagtggcatgatatcagctcactgcaatctcgggctcccgggttcaagccatgcacacactcacccacacataaaaggtggtaac

SEQ ID NO: 2968 - DNA, 67 bp, Artificial Sequence
  Description of Artificial Sequence: Synthetic VEGFA target binding site sequence
acctgtacatctgcacaagattgcctttactccatgcctttcttcttctgctctaactctgacaatc

SEQ ID NO: 2969 - DNA, 39 bp, Artificial Sequence
  Description of Artificial Sequence: Synthetic VEGFA target binding site sequence
acctgtacatctgcacaagattgcctttactccacaatc

SEQ ID NO: 2970 - DNA, 47 bp, Artificial Sequence
  Description of Artificial Sequence: Synthetic VEGFA target binding site sequence
acctgtacatctgcacaagattgcctttactccatactctgacaatc

SEQ ID NO: 2971 - DNA, 47 bp, Artificial Sequence
  Description of Artificial Sequence: Synthetic VEGFA target binding site sequence
acctgtacatctgcacaagattgccttctgctctaactctgacaatc

SEQ ID NO: 2972 - DNA, 48 bp, Artificial Sequence
  Description of Artificial Sequence: Synthetic VEGFA target binding site sequence
acctgtacatctgcacaagattgcctttactccatgcctttctcaatc

SEQ ID NO: 2973 - DNA, 53 bp, Artificial Sequence
  Description of Artificial Sequence: Synthetic VEGFA target binding site sequence
acctgtacatctgcacaagattgcctttactccatgctctaactctgacaatc

SEQ ID NO: 2974 - DNA, 59 bp, Artificial Sequence
  Description of Artificial Sequence: Synthetic VEGFA target binding site sequence
tcctgtacatctgcacaagattgcctttactcccttcttctgctctaactctgacaatc

SEQ ID NO: 2975 - DNA, 67 bp, Artificial Sequence
  Description of Artificial Sequence: Synthetic VEGFA target binding site sequence
tcagacaggacattctgacaccccaggagcaaactccctccatcccacaaatccgtccttagatgtg

SEQ ID NO: 2976 - DNA, 52 bp, Artificial Sequence
  Description of Artificial Sequence: Synthetic VEGFA target binding site sequence
tcagacaggacattcaaactccctccatcccacaaatccgtccttagatgtg

SEQ ID NO: 2977 - DNA, 57 bp, Artificial Sequence
  Description of Artificial Sequence: Synthetic VEGFA target binding site sequence
tcagacaggacattctgagcaaactccctccatcccacaaatccgtccttagatgtg

SEQ ID NO: 2978 - DNA, 58 bp, Artificial Sequence
  Description of Artificial Sequence: Synthetic VEGFA target binding site sequence
tcagacaggacattctgacgcaaactccctccatcccacaaatccgtccttagatgtg

SEQ ID NO: 2979 - DNA, 60 bp, Artificial Sequence
  Description of Artificial Sequence: Synthetic VEGFA target binding site sequence
tcagacaggacatcctgacacgcaaactccctccatcccacaaatccgtccttagatgtg

SEQ ID NO: 2980 - DNA, 65 bp, Artificial Sequence
  Description of Artificial Sequence: Synthetic VEGFA target binding site sequence
tcagacaggacattctgacaccccaggcaaactccctccatcccacaaatccgtccttagatgtg

SEQ ID NO: 2981 - DNA, 69 bp, Artificial Sequence
  Description of Artificial Sequence: Synthetic VEGFA target binding site sequence
tcagacaggacattctgacaccccaggatgtcctcctccctccatcccacaaatccgtccttagatgtg

SEQ ID NO: 2982 - DNA, 105 bp, Artificial Sequence
  Description of Artificial Sequence: Synthetic VEGFA target binding site sequence
  modified_base (5)..(5): a, c, t, g, unknown or other
  modified_base (15)..(16): a, c, t, g, unknown or other
  modified_base (18)..(18): a, c, t, g, unknown or other
  modified_base (32)..(33): a, c, t, g, unknown or other
  modified_base (43)..(43): a, c, t, g, unknown or other
  modified_base (45)..(45): a, c, t, g, unknown or other
  modified_base (47)..(49): a, c, t, g, unknown or other
  modified_base (52)..(53): a, c, t, g, unknown or other
  modified_base (65)..(65): a, c, t, g, unknown or other
tcagncaggacattnngncaccccaggaaacnngagttttcgntncnnnganngtcagacccagnagcaaactccctccatcccacaaatccgtccttagatgtg

SEQ ID NO: 2983 - DNA, 121 bp, Artificial Sequence
  Description of Artificial Sequence: Synthetic VEGFA target binding site sequence
  modified_base (15)..(15): a, c, t, g, unknown or other
  modified_base (31)..(31): a, c, t, g, unknown or other
  modified_base (37)..(37): a, c, t, g, unknown or other
  modified_base (51)..(51): a, c, t, g, unknown or other
  modified_base (57)..(57): a, c, t, g, unknown or other
  modified_base (59)..(62): a, c, t, g, unknown or other
  modified_base (69)..(69): a, c, t, g, unknown or other
  modified_base (71)..(71): a, c, t, g, unknown or other
  modified_base (77)..(78): a, c, t, g, unknown or other
  modified_base (82)..(82): a, c, t, g, unknown or other
tcagacaggacattntgacaccccaggagtntgcacntcagttttctttantatgtngnnnnggggcangnacaaanntttngcaaactccctccatcccacaaatccgtccttagatgtg

SEQ ID NO: 2984 - DNA, 161 bp, Artificial Sequence
  Description of Artificial Sequence: Synthetic VEGFA target binding site sequence
  modified_base (135)..(135): a, c, t, g, unknown or other
  modified_base (137)..(138): a, c, t, g, unknown or other
  modified_base (154)..(154): a, c, t, g, unknown or other
tcagacaggacattctgacaccccaggatgtttgtttgagtcagagtctctcttttgtcacccaggctggagtgcagtggaaacctgtgccttttgtatatcctctttgaaggttaaagagtcatcatggatcancnncataaagcaaactccntccatcc

SEQ ID NO: 2985 - DNA, 314 bp, Artificial Sequence
  Description of Artificial Sequence: Synthetic VEGFA target binding site sequence
tcagacaggacattctgacaccccaggataagcggcagggtcggaacaggagagcgcacgagggagcttccagggggaaacgcctggtatctttatagtcctgtcgggtttcgccacctctaggggagttctgagctctgacgccgggcgtgttaggagatagcaggccgttaatgaccatcccagccgaattcctcactgtgcagatgaggaagtgagctcagggaggctgagtgtcccaggcctgttgccagatgaggccacgctgagactgtgcaaactccctccatcccacaaatccgtccttagatgtg

SEQ ID NO: 2986 - DNA, 67 bp, Artificial Sequence
  Description of Artificial Sequence: Synthetic VEGFA target binding site sequence
tggagagaggctcccatcacgggggagggagtttgctcctggggaacctgtgatccccacagggaac

SEQ ID NO: 2987 - DNA, 56 bp, Artificial Sequence
  Description of Artificial Sequence: Synthetic VEGFA target binding site sequence
tggagagaggctcccatcacgggggagggagtttgcctgtgatccccacagggaac

SEQ ID NO: 2988 - DNA, 60 bp, Artificial Sequence
  Description of Artificial Sequence: Synthetic VEGFA target binding site sequence
tggagagaggctcccatcacgggggagggagtttgggaacctgtgatccccacagggaac

SEQ ID NO: 2989 - DNA, 67 bp, Artificial Sequence
  Description of Artificial Sequence: Synthetic VEGFA target binding site sequence
agcatcgctggactctacccactgaatgccaggagcaaacttcccctccccgagttgtgacagcaaa

SEQ ID NO: 2990 - DNA, 53 bp, Artificial Sequence
  Description of Artificial Sequence: Synthetic VEGFA target binding site sequence
agcatcgctggactctacccactgaatgccaggacccgagttgtgacagcaaa

SEQ ID NO: 2991 - DNA, 58 bp, Artificial Sequence
  Description of Artificial Sequence: Synthetic VEGFA target binding site sequence
agcatcgctggactctacccactgagcaaacttcccctccccgagttgtgacagcaaa

SEQ ID NO: 2992 - DNA, 65 bp, Artificial Sequence
  Description of Artificial Sequence: Synthetic VEGFA target binding site sequence
agcatcgctggactctacccactgaatgccaggcaaacttcccctccccgagttgtgacagcaaa

SEQ ID NO: 2993 - DNA, 200 bp, Artificial Sequence
  Description of Artificial Sequence: Synthetic VEGFA target binding site sequence
agcatcgctggactctacccactgaatgccaggagttcagacgattgaatgtatcaacttggcacattgcctatcaactggtgagtgctcaaaaatatccattgctgtgatcagtaatgccacagggtgaccatttaaggacagagtccatgttttatccatccttagcaaacttcccctccccgagttgtgacagcaaa

SEQ ID NO: 2994 - DNA, 209 bp, Artificial Sequence
  Description of Artificial Sequence: Synthetic VEGFA target binding site sequence
agcatcgctggactctacccactgaatgccagagcccttccttctccctctcttcctccagaggtcctgccgagatcaggttggaggtcctctttgttcttatgcccattcctcccccaggcacttggaggagggcactgtttttgagtgtgcaagtctttctctgttactgttgggcaaacttcccctccccgagttgtgacagcaaa

SEQ ID NO: 2995 - DNA, 253 bp, Artificial Sequence
  Description of Artificial Sequence: Synthetic VEGFA target binding site sequence
  modified_base (53)..(53): a, c, t, g, unknown or other
  modified_base (67)..(67): a, c, t, g, unknown or other
  modified_base (83)..(84): a, c, t, g, unknown or other
  modified_base (91)..(91): a, c, t, g, unknown or other
  modified_base (99)..(99): a, c, t, g, unknown or other
  modified_base (108)..(108): a, c, t, g, unknown or other
agcatcgctggactctacccactgaatgccaggatgttttgtttgcgacggantctcactctgtcgnccgggctggagtgcannggcacanttcctcanctgactgcnatgtccgcctcccggattcaagtgattctcctgccccagcctcccgagtagctgggattataggtgcctgccaccatgcctggctaattttttttttttttttaaatggagtctcactctgttgcccccgagttgtgacagcaaa

SEQ ID NO: 2996 - DNA, 67 bp, Artificial Sequence
  Description of Artificial Sequence: Synthetic VEGFA target binding site sequence
cacctccctatcctcaaaacttggccagaggcggggtggaggggcccctaggagcgccttggtggga

SEQ ID NO: 2997 - DNA, 54 bp, Artificial Sequence
  Description of Artificial Sequence: Synthetic VEGFA target binding site sequence
cacctccctatcctcaaaacttggccagaggcggggtggagcgccttggtggga

SEQ ID NO: 2998 - DNA, 60 bp, Artificial Sequence
  Description of Artificial Sequence: Synthetic VEGFA target binding site sequence
cacctccctatcctcaaaacttggcggggtggaggggcccctaggagcgccttggtggga

SEQ ID NO: 2999 - DNA, 61 bp, Artificial Sequence
  Description of Artificial Sequence: Synthetic VEGFA target binding site sequence
cacctccctatcctcaaaacttggacggggtggaggggcccctaggagcgccttggtggga

SEQ ID NO: 3000 - DNA, 65 bp, Artificial Sequence
  Description of Artificial Sequence: Synthetic VEGFA target binding site sequence
cacctccctatcctcaaaacttggccaggcggggtggaggggcccctaggagcgccttggtggga

SEQ ID NO: 3001 - DNA, 141 bp, Artificial Sequence
  Description of Artificial Sequence: Synthetic VEGFA target binding site sequence
  modified_base (36)..(36): a, c, t, g, unknown or other
  modified_base (43)..(43): a, c, t, g, unknown or other
  modified_base (67)..(67): a, c, t, g, unknown or other
  modified_base (79)..(79): a, c, t, g, unknown or other
  modified_base (106)..(106): a, c, t, g, unknown or other
  modified_base (125)..(125): a, c, t, g, unknown or other
  modified_base (136)..(137): a, c, t, g, unknown or other
cacctccctatcctcaaaacttggccagagacttanacctaanacctcaaactatgagactgctacnagagaacatcanaaaaactttccaggacattcttctggnggggtggaggggcccctangagcgccttgnnggga

SEQ ID NO: 3002 - DNA, 217 bp, Artificial Sequence
  Description of Artificial Sequence: Synthetic VEGFA target binding site sequence
cacctccctatcctcaaaacttggccagagtctacagatttataaaatattaccagttaatcatgacacatattgtttattttcaaatattttttctagttaaacccaccatttatataaccaattatatttgatattatttaaaatttttgtattaacaccccaccaaatcattttacagcggggtggaggggcccctaggagcgccttggtggga

SEQ ID NO: 3003 - DNA, 67 bp, Artificial Sequence
  Description of Artificial Sequence: Synthetic VEGFA target binding site sequence
gtcggtgccccacatgtggcagatgcccagaggcggggtgtggggggtactttgtgggcgttttggg

SEQ ID NO: 3004 - DNA, 48 bp, Artificial Sequence
  Description of Artificial Sequence: Synthetic VEGFA target binding site sequence
gtcggtgccccacgcggggtgtggggggtactttgtgggcgttttggg

SEQ ID NO: 3005 - DNA, 55 bp, Artificial Sequence
  Description of Artificial Sequence: Synthetic VEGFA target binding site sequence
gtcggtgccccacatgtggcgcggggtgtggggggtactttgtgggcgttttggg

SEQ ID NO: 3006 - DNA, 62 bp, Artificial Sequence
  Description of Artificial Sequence: Synthetic VEGFA target binding site sequence
gtcggtgccccacatgtggcagatgcccagaggtgtggggggtactttgtgggcgttttggg

SEQ ID NO: 3007 - DNA, 62 bp, Artificial Sequence
  Description of Artificial Sequence: Synthetic VEGFA target binding site sequence
gtcggtgccccacatgtggcagatgcccaggggtgtggggggtactttgtgggcgttttggg

SEQ ID NO: 3008 - DNA, 63 bp, Artificial Sequence
  Description of Artificial Sequence: Synthetic VEGFA target binding site sequence
gtcggtgccccacatgtggcagatgcccagagggtgtggggggtactttgtgggcgttttggg

SEQ ID NO: 3009 - DNA, 63 bp, Artificial Sequence
  Description of Artificial Sequence: Synthetic VEGFA target binding site sequence
gtcggtgccccacatgtggcagatgcccgcggggtgtggggggtactttgtgggcgttttggg

SEQ ID NO: 3010 - DNA, 65 bp, Artificial Sequence
  Description of Artificial Sequence: Synthetic VEGFA target binding site sequence
gtcggtgccccacatgtggcagatgcccaggcggggtgtggggggtactttgtgggcgttttggg

SEQ ID NO: 3011 - DNA, 67 bp, Artificial Sequence
  Description of Artificial Sequence: Synthetic VEGFA target binding site sequence
gtccctctgggccccatcctcccctccccacccaccccgcctcaggcttgaagaggaaagaagagca

SEQ ID NO: 3012 - DNA, 31 bp, Artificial Sequence
  Description of Artificial Sequence: Synthetic VEGFA target binding site sequence
  modified_base (17)..(17): a, c, t, g, unknown or other
  modified_base (20)..(20): a, c, t, g, unknown or other
  modified_base (22)..(24): a, c, t, g, unknown or other
  modified_base (26)..(27): a, c, t, g, unknown or other
  modified_base (29)..(31): a, c, t, g, unknown or other
gtccctctgggccccanagnannnannannn

SEQ ID NO: 3013 - DNA, 48 bp, Artificial Sequence
  Description of Artificial Sequence: Synthetic VEGFA target binding site sequence
gtccctctgggccccatcctcccctcccctgaagaggaaagaagagcg

SEQ ID NO: 3014 - DNA, 50 bp, Artificial Sequence
  Description of Artificial Sequence: Synthetic VEGFA target binding site sequence
  modified_base (9)..(11): a, c, t, g, unknown or other
  modified_base (13)..(14): a, c, t, g, unknown or other
  modified_base (16)..(16): a, c, t, g, unknown or other
  modified_base (20)..(20): a, c, t, g, unknown or other
  modified_base (22)..(22): a, c, t, g, unknown or other
gtccctctnnncnncntccncncctcaggcttgaagaggaaagaagagcg

SEQ ID NO: 3015 - DNA, 54 bp, Artificial Sequence
  Description of Artificial Sequence: Synthetic VEGFA target binding site sequence
gtccctctgggccccatcctcccctccctcaggcttgaagaggaaagaagagcg

SEQ ID NO: 3016 - DNA, 57 bp, Artificial Sequence
  Description of Artificial Sequence: Synthetic VEGFA target binding site sequence
gtccctctgggccccatcctcccctccccactcaggcttgaagaggaaagaagagcg

SEQ ID NO: 3017 - DNA, 59 bp, Artificial Sequence
  Description of Artificial Sequence: Synthetic VEGFA target binding site sequence
  modified_base (8)..(14): a, c, t, g, unknown or other
  modified_base (25)..(26): a, c, t, g, unknown or other
  modified_base (30)..(30): a, c, t, g, unknown or other
  modified_base (32)..(32): a, c, t, g, unknown or other
gtccctcnnnnnnncctcctccccnncccncnctcaggcttgaagaggaaagaagagcg

SEQ ID NO: 3018 - DNA, 61 bp, Artificial Sequence
  Description of Artificial Sequence: Synthetic VEGFA target binding site sequence
gtccctctgggccccatcctcccctccccacccactcaggcttgaagaggaaagaagagcg

SEQ ID NO: 3019 - DNA, 62 bp, Artificial Sequence
  Description of Artificial Sequence: Synthetic VEGFA target binding site sequence
gtccctctgggccccatcctcccctccccacccacctcaggcttgaagaggaaagaagagcg

SEQ ID NO: 3020 - DNA, 125 bp, Artificial Sequence
  Description of Artificial Sequence: Synthetic VEGFA target binding site sequence
gtccctctgggccccatcctcccctccccacccaccccgcatcgtacgtgtccttactaagctgcaatttggcatcttcagctaagtcgaagttcgacctcaggcttgaagaggaaagaagagcg

SEQ ID NO: 3021 - DNA, 67 bp, Artificial Sequence
  Description of Artificial Sequence: Synthetic VEGFA target binding site sequence
gagagcgagtgagtgagtgagtgagtgtgtgtgtgggggggactcggcttgttgttgtcggtgactt

SEQ ID NO: 3022 - DNA, 347 bp, Artificial Sequence
  Description of Artificial Sequence: Synthetic VEGFA target binding site sequence
  modified_base (30)..(30): a, c, t, g, unknown or other
  modified_base (33)..(33): a, c, t, g, unknown or other
  modified_base (35)..(38): a, c, t, g, unknown or other
  modified_base (186)..(190): a, c, t, g, unknown or other
  modified_base (192)..(194): a, c, t, g, unknown or other
  modified_base (315)..(315): a, c, t, g, unknown or other
  modified_base (318)..(318): a, c, t, g, unknown or other
gagagcgagtgagtgagtgagtgagtgtgngtntnnnnatttcacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaannnnngnnnagaggcggtttgcgtattgggcgctcttccgcttcctcgctcactgactcgctgcgctcggtcgttcggctgcggcgagcggtatcagctcactcaaaggcggtaatacggttatccacanaangggactcggcttgttgttgtcggtgactt

SEQ ID NO: 3023 - DNA, 67 bp, Artificial Sequence
  Description of Artificial Sequence: Synthetic VEGFA target binding site sequence
tggaggtgttgggatgcgggagtgggtgagtgagtgcgtgcgggtggcgatgcaagcgtgtgcgaat

SEQ ID NO: 3024 - DNA, 59 bp, Artificial Sequence
  Description of Artificial Sequence: Synthetic VEGFA target binding site sequence
tggaggtgttgggatgcgggagtgggtgcgtgcgggtggcgatgcaagcgtgtgcgaat

SEQ ID NO: 3025 - DNA, 59 bp, Artificial Sequence
  Description of Artificial Sequence: Synthetic VEGFA target binding site sequence
tggaggtgttgggatgcgggagtgggtgagtgcgggtggcgatgcaagcgtgtgcgaat

SEQ ID NO: 3026 - DNA, 67 bp, Artificial Sequence
  Description of Artificial Sequence: Synthetic VEGFA target binding site sequence
caaagacagtagatcttaaatgtcctcacgcacacactcacccacacataaaaggtggtaactgtgt

SEQ ID NO: 3027 - DNA, 57 bp, Artificial Sequence
  Description of Artificial Sequence: Synthetic VEGFA target binding site sequence
caaagacagtagatcttaagcacacactcacccacacataaaaggtggtaactgtgt

SEQ ID NO: 3028 - DNA, 60 bp, Artificial Sequence
  Description of Artificial Sequence: Synthetic VEGFA target binding site sequence
caaagacagtagatcttaaatgtcctcacgtcacccacacataaaaggtggtaactgtgt

SEQ ID NO: 3029 - DNA, 62 bp, Artificial Sequence
  Description of Artificial Sequence: Synthetic VEGFA target binding site sequence
caaagacagtagatcttaaatgtcgcacacactcacccacacataaaaggtggtaactgtgt

SEQ ID NO: 3030 - DNA, 138 bp, Artificial Sequence
  Description of Artificial Sequence: Synthetic VEGFA target binding site sequence
  modified_base (36)..(36): a, c, t, g, unknown or other
caaagacagtagatcttaaatgtcctcacgccgacnattgcatgaagaatctgcttagggttaggcgttttgcgctgcttcgcgatgtacgggccagatagcacacactcacccacacataaaaggtggtaactgtgt

SEQ ID NO: 3031 - DNA, 224 bp, Artificial Sequence
  Description of Artificial Sequence: Synthetic VEGFA target binding site sequence
caaagacagtagatcttaaatgtcctcacgcaaattttattttggttcatgatatggcttggcgtgtatgcttttcatttgtaaaattgctgttcttttgacaatttaagtgactgtttcattgactacaagtttgaaaataaaaattaattaagaaaaaaattccaatgactgtgctgtggttgggcacacactcacccacacataaaaggtggtaactgtgt

SEQ ID NO: 3032 - DNA, 257 bp, Artificial Sequence
  Description of Artificial Sequence: Synthetic VEGFA target binding site sequence
  modified_base (90)..(90): a, c, t, g, unknown or other
caaagacagtagatcttaaatgtcctcacgtggaaacatagtagatgaggtggcatatcatgaaaagtacccaacgatttatcacctcanaaaaaagctagttgactcaactgataaagcggacctgaggttaatctacttggctcttgcccatatgataaagttccgtgggcactttctcattgagggtgatctaaatccggacaactcggatgtcgagcacacactcacccacacataaaaggtggtaactgtgt

SEQ ID NO: 3033 - DNA, 278 bp, Artificial Sequence
  Description of Artificial Sequence: Synthetic VEGFA target binding site sequence
caaagacagtagatcttaaatgtcctcacgttatttagagacagagtctcactctgttgcccaggctggggtgcagtggtacgaactcggctcactgcaacctccgtctcctgggctcaagtgattatcctgcctcagcctcccgagtagctgggattacaggtgcccaccaccacacccggctaatttttgtattttcagtagagctggggtttcaccatgttggccagcctgttctcggcacacactcacccacacataaaaggtggtaactgtgt

SEQ ID NO: 3034 - DNA, 67 bp, Artificial Sequence
  Description of Artificial Sequence: Synthetic VEGFA target binding site sequence
gattgcctttactccatgcctttcttcttctgctctaactctgacaatctgtcttgccatgccataa

SEQ ID NO: 3035 - DNA, 58 bp, Artificial Sequence
  Description of Artificial Sequence: Synthetic VEGFA target binding site sequence
gattgcctttactccttcttctgctctaactctgacaatctgtcttgccatgccataa

SEQ ID NO: 3036 - DNA, 61 bp, Artificial Sequence
  Description of Artificial Sequence: Synthetic VEGFA target binding site sequence
gattgcctttactccatgcctttctgctctaactctgacaatctgtcttgccatgccataa

SEQ ID NO: 3037 - DNA, 61 bp, Artificial Sequence
  Description of Artificial Sequence: Synthetic VEGFA target binding site sequence
gattgcctttactccatgctcttctgctctaactctgacaatctgtcttgccatgccataa

What is claimed is:

1. A method of increasing specificity of S. pyogenes CRISPR-Cas9 (Cas9) RNA-guided genome editing in a cell, the method comprising contacting the cell with a guide RNA that includes a complementarity region at the 5' end of the guide RNA consisting of 17-18 nucleotides that are complementary to 17-18 consecutive nucleotides of the complementary strand of a selected target genomic sequence, wherein the selected target genomic sequence is immediately 5' of a protospacer adjacent motif (PAM), the guide RNA comprises
SEQ ID NO:4, and wherein in the presence of a S. pyogenes Cas9 genome editing enzyme, the guide RNA complementarity region binds and directs the Cas9 genome editing enzyme to the selected target genomic sequence, thereby increasing specificity of RNA-guided genome editing in a cell.

2. A method of inducing a break in a target region of a double-stranded DNA molecule in a cell, the method comprising expressing in or introducing into the cell:
a S. pyogenes CRISPR/Cas9 nuclease or nickase; and
a guide RNA that includes a complementarity region at the 5'end of the guide RNA consisting of 17-18 nucleotides that are complementary to 17-18 consecutive nucleotides of the complementary strand of a double-stranded DNA molecule comprising a target sequence, wherein the target sequence is immediately 5' of a protospacer adjacent motif (PAM), and wherein the guide RNA complementarity region binds and directs the Cas9 nuclease or nickase to the target region of a double-stranded DNA molecule, and wherein the guide RNA comprises
SEQ ID NO:4, thereby inducing a break in the target region of a double-stranded DNA molecule in a cell.

3. A method of modifying a target region of a double-stranded DNA molecule in a cell, the method comprising expressing in or introducing into the cell:
a S. pyogenes CRISPR dCas9-heterologous functional domain fusion protein (dCas9-HFD); and
a guide RNA that includes a complementarity region at the 5'end of the guide RNA consisting of 17-18 nucleotides that are complementary to 17-18 consecutive nucleotides of the complementary strand of a selected target sequence present on a double-stranded DNA molecule, wherein the selected target sequence is immediately 5' of a protospacer adjacent motif (PAM), the guide RNA comprises
SEQ ID NO:4, and wherein the guide RNA complementarity region binds and directs the dCas9-HFD to the selected target sequence, thereby modifying a target region of a double-stranded DNA molecule in a cell.

4. The method of claim 1, wherein the target region is in a target genomic sequence.

5. The method of claim 3, wherein dCas9-HFD comprises a heterologous functional domain (HFD) that modifies gene expression, histones, or DNA.

6. The method of claim 5, wherein the HFD is a transcriptional activation domain, an enzyme that catalyzes DNA demethylation, an enzyme that catalyzes histone modification, or a transcription silencing domain.

7. The method of claim 6, wherein the transcriptional activation domain is from activator domain VP64 or NF-kappa B subunit p65 (NF-κB p65).

8. The method of claim 6, wherein the enzyme that catalyzes histone modification is lysine-specific histone demethylase 1 (LSD1), a histone methyltransferase (HNMT), histone acetyltransferase (HAT), histone deacetylase (HDAC), or histone demethylase.

9. The method of claim 6, wherein the transcription silencing domain is from Heterochromatin Protein 1 alpha (HP1α) or Heterochromatin Protein 1 beta (HP1β).

10. The method of claim 1, wherein the cell is a eukaryotic cell.

11. The method of claim 10, wherein the cell is a mammalian cell.

* * * * *